United States Patent 7,745,391 (HUMAN THROMBOSPONDIN POLYPEPTIDE) - sequence listing, part 185

SEQ ID NO: 449297 - DNA, 4722 bp, Homo sapiens
gatgacaggttcttggagacccagctgtgtgctgtgttgatgggcaaacatgaggtgggccccaggggaaaggagctgttctggactctgtgaatgctgctgctcccaagggcggtgcccaggtgagatgcctgcgggggaagcagcaggagctaccacctccacccagccactgcattctggagcagcgcttcccaaacttcagtgtgtgcaccgatcacctagggccttttttttttttttcctttttgtggagaacgggtctcgctagattgcccaggcaggtctcaaactcctgggctcaagccatcctcctgcctctgcctccctaagagttgggattaccggcttgagccactgtgcctggcttgtttgttttgtattaattacatttttatagagagagatggggtcttactttgttgcccgggctggttgcaaactcctgggcctcaagggaacctcccatttcagcctcccaaagtgccggaattgcaggcgtgagccactgcctggcttgttttttttgttttttgtttttttttttctgagacggagtcttgctctgtcgcccaggctggagtgcagtggtgcgatcgtggctcactgcaagctcggcctcccgggttcgctccattctcctgcctcagcctcccaagtagctgggactataggcacctgccataacacccggataattttttgtattttagtagagacggggtttcaccgtgttagccaggatggtgtcgatctcctgaccttgtgatctgcccacctcggcctcctgagtaccttgttaaacacccaagtctaggccccatcctagacctacagaatcagaattcctagtgttaggctgggtgcagtggctcgcacctgtggtctcagcactttgggaggctcaagtgggaggatcatttgagcccaggagttcgagaccagcctgggcaacatagtgaaaccctctctacaaaaaatttaaaacttagctgggtggtgcatgcctgtggtcccagctccttgggatgctgaggtgggaggatcgcctgagcctgggaggttgcggctacagtgagctgtgatcatgctactgcactccagcctgggcgagagcaagatctcttctcttaaataaatttaaaaaaagaatccctgggccaggtgtggtggctcatgcctgtaatcacttttgggagcccaaggtaggtggatcacctgagatcaggagttcaagaccagcttggccaacacggtgaaacccccatctctaaaaatataaaaaaaattagctggacatggtggcctgcagtgcaatcccagctactctggaggctgaggcagggagaatcgcttaaacccgggagctggaggttgtagtgagccgagatcacgccattgcactccatcctgggcgacagagtgagactctgtctcaaaaaaaaaaaaaaaaggaatccgtggtgtagtccgagcgcggtggctcacgcctgtaatcccagcattttgggaagctgaggcaggcagatcccttgaggtcaggagttcgagaccagcctggccaacatggcgaaaccccatctctactaaaaatacaaaaattagccaggtgtggtggcacatgcctgtaattccagttactcaggaggctgaggcaggagaattgcttgaacccaggaggcggaagtagtggtgagctgagatcataccactgcactccagcctgggtgacagagggagactctgttgcaaaaaaaaaaaagaatccctgatgatagaacctgagaatctgtagttaagaggctccccgggtggtcatgcaaaccagtgtgtgggaagcagtgttgagagtgcctcagagaagctcgttccatgaaaattgtgtgcagaccccagggccccattttcagaggattatgcagcttgacctgcaggaagccactgctgatgcctgttgagtggctgcctggggatgggcactgcccgatgacgggcaggaggaccactacctacacctggctgtcctacagtagttttcaggtgtctgtgcctggcaccagccaccagcagtatccctgcgtctggccctggtcctctaggagcggaaggggagaagggcactgccgtgggagagagacctgccatttagattacatttggctttgagggttgaatggtgtgtttgcaaagccaggaatgatcatgagctctgtctgctcccataggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgac

SEQ ID NO: 449298 - DNA, 2852 bp, Homo sapiens
gcgcggggatgcggctgtgggcgccggggccgggtagctgctccaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcggggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctcctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgac

SEQ ID NO: 449299 - DNA, 2124 bp, Homo sapiens
gcgcggggatgcggctgtgggcgccggggccgggtagctgctccaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcggggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaa

SEQ ID NO: 449300 - DNA, 1478 bp, Homo sapiens
gcgcggggatgcggctgtgggcgccggggccgggtagctgctccaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcggggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgac

SEQ ID NO: 449301 - DNA, 1414 bp, Homo sapiens
gcgcggggatgcggctgtgggcgccggggccgggtagctgctccaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcggggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatcgtggcagccggtggctcttcctttctgaccagttcccactgcgcagggactggctgttgggtt

SEQ ID NO: 449302 - DNA, 455 bp, Homo sapiens
agcgcaggggccgggcggcgcgggcgccgggcgcggggatgcggctgtgggcgccggggccgggtagctgctccaggcgcgcgagctaaccgagtgcggcgagggcctaccaggggcgacaggcacgttgcatgcatgccttgggcgcagcctttgcgaaagccggttgggtgtgcgttggtgcttcagcggcgccgtggagggtccgggtcgccgggggatgggcaccagcgccgaagccaggctggcaccgctcgctgaaagagcccttggctgggcttgtgtgggggagtgctgcacgcctgggcagtgcgcgacgtgtttgttctttttctctttttgtgccagggtttctctccgcaagcgcgcgatgcagcgggcggcggcgctggtccggcggggctgtggtccccggacccccagctcctggggccgcagccagagcagcgcggccg

SEQ ID NO: 449303 - DNA, 3692 bp, Homo sapiens
taaaagggtacgcacgaaaggacccttgagagtttggcccgacaatgtacagtgcaatcagtatgagacaggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgac

SEQ ID NO: 449304 - DNA, 3138 bp, Homo sapiens
cagggcactgagtgattctggatgggcttctgacctggggacaatttaaacagcattacaaccgacattttggttttcttggggattttataggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgac

SEQ ID NO: 449305 - DNA, 3219 bp, Homo sapiens
gcgcggggatgcggctgtgggcgccggggccgggtagctgctccaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcggggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgac

SEQ ID NO: 449306 - DNA, 1474 bp, Homo sapiens
gcgcggggatgcggctgtgggcgccggggccgggtagctgctccaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcggggtatcaaaaagccattcacagaggtcatccgagccaacatcggggacgcccaggctatggggcagcagccaatcaccttcctccggcaggtgatggcactatgcacctacccaaacctgctggacagccccacttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgac

SEQ ID NO: 449307 - DNA, 2444 bp, Homo sapiens
gcgcggggatgcggctgtgggcgccggggccgggtagctgctccaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcggggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaacaacaaccaacaaacacacaaaaaaaaaaaaatttggggggcgctggggctcggaaaaaggtttcctaagaacccaatctcggtggggcgcggggccaagtgaagggtacggtgagcaccttgggcatcagcggtgtgtccccagagaggaaaacccctggggccaggacaaaggggctgggtgttctcccaccaaaattaaaaaaagcggcgggggggacacccggcgggggttgtggacaaatcccaggaggaggccggggggacatgcgggctcacacacggaggtccaagggagcgatataattaagcgcgagggg

SEQ ID NO: 449308 - DNA, 698 bp, Homo sapiens
gcgcggggatgcggctgtgggcgccggggccgggtagctgctccaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcgggtgagcgcgcgctgggccccggggaggctggggccgctgagcaagggaaaaaccgcagcagccccagctggggtccttcccacgacgtccacccccatggccagctcctcagtcagccaagcctggctaaaacgagagaatgccccctcccgcccgttcacttactggtgcccagcaccgggcactcagtgaggccttgcaatacggttcacttgttgaattgaattcgtcaattgttgagcgggccgtgctgccaggcaccgcacgttgtgtgtctgccctactctcgtggaaccaaggtccagtggagagaggaacataagcgaatgaagaaagaagca

SEQ ID NO: 449309 - DNA, 154 bp, Homo sapiens
ggctgctgcagaggacagaggtgaacagcaaacgggatgaacactcactgtgtgctccatgacagccaccccggcccccacagcctcacaccacaggatgggaccagtatgatcctgagaggctcccagagatgtccagccttgaccaagaccg

SEQ ID NO: 449310 - DNA, 2554 bp, Homo sapiens
agtactcgttttctgggtttttgttattttttagtggtaacacaagcctatagggcatttatagccacctattatactgtttccataagcctggctaccttttagggaagctattttttctctttcatttttactgtcacagcacatacacacacacctttttgttttaaaggattaagtactgtttgaagatcagtggtaacagaaaatttgggagggagaagaagaaattaagacatgacttgttagaaaattaagacttcagtttctagaattatcttttcatcaagatttggtagacattgagtttaaatggaaaggaaattatttaagcctgtgtatgttagatccacaatacaccattggtattgaaatataaaggttaaaaaaaaggcttatgacctctttaatgagataaatatgtatttgtcttgtaagcaggcagaaaatctacctctaattttaacactaatactttgaaacccacaatcaaatagagtgaattctccaagttacataagcaaggaaaacattatttgaaatatgccatgttttcgttgcctttggacacctcatcattcaactctaattttaccgagtcccgggatttgtactgtcccattgtacttgcaatctacaatttatataatagaaaaacaaccaaacccattcatacaaggatctgaagttataaggttaagggcagaaagtttcccataagtataaaacatttccaggtcatgaagagtagtttaggttgagtgacaaaagcctaggtgtggttgtttttcattcattttgcatctcacaccaagacatttttgctgcaaggtcatctgctgcttaaaatgtacaattaggtatataaaataagtacaatggtgaaaacacaaagccaggtaaagcagcatgccccactaaatttttcagtatacatagggacagacaagtgagttttggttgtatctaaatattttaatttcaggttccttctgtgccctgggccactatttcccaggggtgtgacagagatgcctgccagatccatatcaactagaagtctgatttctgttgctgcccttcctcagcaactatggcagtatacttttatcaccaagcaccactcccttgtccctgaatcacattttaatagagtacaatatcttctgtacaatatttctgaaacacttatgtctgaaatatatgctgtattgtatgttaacccatgacatatatgaactacaaggcttgcataatcagtgagctagtggataaatcaagacaggagcaaatgggagaaagatgaataaacaaatgaaaaaagatgaataaatgaataagagagatgaataaacaaatttacattacatgtgatagttatcatggtatggccttcatgacaagatggatgagaatatcactgataggatattagccttctttcatatctttatattgaaatatgggctttacttcaatttgaaggtctttcatgaacaataaaagagagtagaaggactgtctgagaaggcaggagacatataaaacagatgactgaaagactgactagctcctggaaagggaaacatttggaacatccagagtaagggcaaatgggcttctaccagcacaacaaagagcctccaggtggcaacatggaagcaggttatcagagaaaataaatgtgcaaattccttatttacaatgactcacttaaccccacaaacatgtttcactgctgccttccccagttgtcgcttatgtactgttgttacctttcagttacatgcctttgatcctaaaattctctacttttgttgccttatcagttctttgcaatctgcctgtggttatcagcacttaaagcacaattttgaaggggaaaaaaatgataatcaccttagtcccaaagaaataatttgtcaaactgccttattagtattaaaaacagacacactgaatgaagtagcatgatacgcatatatcctactcagtatcattggccttttatcaaatggggaaactatacttttgtattacatagttttagaaatcgaaagttagagactctttataagtaatgtcaaggaacagtaatttaaaaacaaagttctaacaaatatattgtttgcttaatcacaatgccctcaacttgtatttgaataactaaataggacatgtcttccttggagctgtgggcattagttcagaagcactacctgcatcttaattttcaaaacttaagttttattagcaaatcctcttctctgtaagacttagctatgaagtggtatattttttccaaatatttttctgaaaacatttgttgttgtaactgcacaataaaagtccgtgccaacaaaaaacacacaaaaaaaaaaattggcggggctggccggaaaagtttaaaccactctggcggggggccaggaagaatggaaggccagaaccggcgacgggggtctccccaaaacggggcgggttaaccggttggtttgttcagcacccccccccccccgccgaaacagacaaaaaagaacaaaatcggaaaaac

SEQ ID NO: 449311 - DNA, 1609 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449312 - DNA, 1642 bp, Homo sapiens
cccagtgcagggcctggaccgtgctccatagcaagcactgatcttgggctattggttttggaggaaagagggagcacaaggatggaaggggccagggaagagaggtcacggtgggagaaggagagtccgcatccatcggagggtttgtcactcaggcctgagtgggaggcactggaggcagggagaggccagtcagcagcatgcggccacagcccagagaagccagaggggtttgctggtgggtgggccccagccttttcaagggaacggcaggtctggggagctgccgatctcggggtgtgagggtaacgggcaggctgtggcccacccctccttctcaggctcactggacccctgaccggtttcatcaccattatccaaggctttgaaaagaccccctggccttcctgccacatgtgccctagctatagggcttcgttcccctccacaaatggtgcagacagcatgagccaccctggcagggggctgggggtccgtggggtaggagttgggggtagctgagcgttctttcctgtccccacggtgcctggtgctggggcttggcagccagggttgggacagcctggctttagcaggtcctgagtcaggggtctcaggctccgcagcacacagtccccaggcaggtgtcaggatgggatgtggccagagaaaggcatgtgctctgtctggggatagctgccacccagctgacacagttggcatgagattgtggagttttatggagtaaaatcacaaatctgggttttttaagtaaaaccttctatgagttgccatctctggccttcaacataggatttgggtctttcctgggtgagctggtgctttgtgggccaggccctgggagctgcaagtaccagttgggatctgccattgccctgtggaaggattttaagcaggggtgaaacatggtcagacttggattctagagatgaggaaaacaaaacaaaatcacggtgccagagtctctggggagactggagaatgcagtgcaggggccgcaggagccaaaaaggggcactggtcctgcgaagagtggctctgtccatccctgccttccagtatgtgcccactgtgaccagagctccatttctcaaaagaagccagtgatgccaattaccatgagaaatttccttatttttaactgtcgattaaaatttgtacaagtatggtggggcaggcctgcaaaatgatctccaagtgcctggcctttgatgcccgtcctaaaagcatgtgtggcactggagggcccacgtttctttgttcctcttgagaagctggggtgggggccggctgggctcagggtgcggcccctcagcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449313 - DNA, 2272 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgcaaaaaaaaaaaaaaaaaaaaaaaaaaaaaaaaaaaaaaaaaaaaaaaaaaaaaaaaaaaaaggggggggcgcgcgcaaagactcatcccgcaggaggggcccacaggatcaacgccagcccccagcagttagtcggacacaaggaggggcccccatatatggggcggtgacaaattaatatgatgcgagagacggcggcgcacatactacaacaacaggcacgtcgagcaggcgagcaaacaggcacgaaacgcggaggagcacacctgcttgagagaaagaacacccacaaatcaacgcgggcgggaggggagcacccaacaggaggacaacaacaacccacccagcaagcgataataagataaacgcgcaggagaggaacacaatacaaacaacagacgcaacgggagatcatacggagggtagtcacacccacggacgcaaagatgcacagcggggatg

SEQ ID NO: 449314 - DNA, 1622 bp, Homo sapiens
  misc_feature (280)..(280): n is a, c, g, or t
  misc_feature (286)..(286): n is a, c, g, or t
  misc_feature (303)..(303): n is a, c, g, or t
  misc_feature (307)..(307): n is a, c, g, or t
  misc_feature (311)..(311): n is a, c, g, or t
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagtttttgtngataanaaaaaaaaagaaaagangtgnatanaaagagtcgagctgcaggaaggcggggacggcccaggagcggaggagcagacagcggtggccatcaccagcgtccagcaggcggcgttcggcgaccacaacatccagtaccagttccgcacagagacaaatggaggacaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449315 - DNA, 2251 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgcaaaaaaaaaaaaaaaaaaaaaaaaaaaaaaaaaaaaaaaaggggggggcgcgcgcaaagactcatcccgcaggaggggcccacaggatcaacgccagcccccagcagttagtcggacacaaggaggggcccccatatatggggcggtgacaaattaatatgatgcgagagacggcggcgcacatactacaacaacaggcacgtcgagcaggcgagcaaacaggcacgaaacgcggaggagcacacctgcttgagagaaagaacacccacaaatcaacgcgggcgggaggggagcacccaacaggaggacaacaacaacccacccagcaagcgataataagataaacgcgcaggagaggaacacaatacaaacaacagacgcaacgggagatcatacggagggtagtcacacccacggacgcaaagatgcacagcggggatg

SEQ ID NO: 449316 - DNA, 1047 bp, Homo sapiens
gtgtggcgttctagaggatcccattaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449317 - DNA, 1757 bp, Homo sapiens
  misc_feature (1614)..(1615): n is a, c, g, or t
  misc_feature (1619)..(1619): n is a, c, g, or t
  misc_feature (1621)..(1621): n is a, c, g, or t
  misc_feature (1628)..(1628): n is a, c, g, or t
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatggagagganntggngncacggcngacatgggaggcagtccccactggtggacatcctggggggtgttatttcgaatgcacacagagtagaagcagcccaaaaaagggatccgagacctgagataaaacaccaatatgcaaaatgtatgaatg

SEQ ID NO: 449318 - DNA, 1679 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccgccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449319 - DNA, 1902 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcaggtgggtgcggggcctggagcgggtcagggcccaggagccccagatgcaaggcgctggccctcagctcccttgacctccgtcgtgtccgccagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449320 - DNA, 1965 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcggtgagcaccccggaccctcagtgtctgcggtggtcccggcccccgacccttgcatgcagaaagtccaacagccatggggctcgggagtcatccctggggtggaggccggtgggcggtgcctgccctaaggctcctggtcccctcgccccccagagagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449321 - DNA, 2057 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcggtgagcaccccggaccctcagtgtctgcggtggtcccggcccccgacccttgcatgcagaaagtccaacagccatggggctcgggagtcatccctggggtggaggccggtgggcggtgcctgccctaaggctcctggtcccctcgccccccagagagtaaaggagggatcctgtccaaggcctgcgattacatccgggagttgcgccagaccaaccagcgcatgcaggagaccttcaaagaggccgagcggctgcagatggacaacgagctcctgaggcagcaggtgggtgcggggcctggagcgggtcagggcccaggagccccagatgcaaggcgctggccctcagctcccttgacctccgtcgtgtccgccagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449322 - DNA, 2342 bp, Homo sapiens
cccagtgcagggcctggaccgtgctccatagcaagcactgatcttgggctattggttttggaggaaagagggagcacaaggatggaaggggccagggaagagaggtcacggtgggagaaggagagtccgcatccatcggagggtttgtcactcaggcctgagtgggaggcactggaggcagggagaggccagtcagcagcatgcggccacagcccagagaagccagaggggtttgctggtgggtgggccccagccttttcaagggaacggcaggtctggggagctgccgatctcggggtgtgagggtaacgggcaggctgtggcccacccctccttctcaggctcactggacccctgaccggtttcatcaccattatccaaggctttgaaaagaccccctggccttcctgccacatgtgccctagctatagggcttcgttcccctccacaaatggtgcagacagcatgagccaccctggcagggggctgggggtccgtggggtaggagttgggggtagctgagcgttctttcctgtccccacggtgcctggtgctggggcttggcagccagggttgggacagcctggctttagcaggtcctgagtcaggggtctcaggctccgcagcacacagtccccaggcaggtgtcaggatgggatgtggccagagaaaggcatgtgctctgtctggggatagctgccacccagctgacacagttggcatgagattgtggagttttatggagtaaaatcacaaatctgggttttttaagtaaaaccttctatgagttgccatctctggccttcaacataggatttgggtctttcctgggtgagctggtgctttgtgggccaggccctgggagctgcaagtaccagttgggatctgccattgccctgtggaaggattttaagcaggggtgaaacatggtcagacttggattctagagatgaggaaaacaaaacaaaatcacggtgccagagtctctggggagactggagaatgcagtgcaggggccgcaggagccaaaaaggggcactggtcctgcgaagagtggctctgtccatccctgccttccagtatgtgcccactgtgaccagagctccatttctcaaaagaagccagtgatgccaattaccatgagaaatttccttatttttaactgtcgattaaaatttgtacaagtatggtggggcaggcctgcaaaatgatctccaagtgcctggcctttgatgcccgtcctaaaagcatgtgtggcactggagggcccacgtttctttgttcctcttgagaagctggggtgggggccggctgggctcagggtgcggcccctcacttcccagggctgtggtctcggtggggcctgcactgttcctgggtgtcctcgggctgagcctctgccctgtgaggacggccgctcaggcatgagccgtcagcgaacccgtggctgtgactctgttttccgcagttggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449323 - DNA, 1020 bp, Homo sapiens
ccacgccggcctctgcagcccccttccccagccccccggacacacccttactctccaaaaatagctggaaccagaacaccccgagatgagaggagaagaagcccagtcaaccaaaacccggaaaaaagtttgggggcatcgagcgactggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449324 - DNA, 1399 bp, Homo sapiens
attaggcgcgttctgcgtctgtggggacgctcctagagagagtcggccgcagcgagggcacagacaggctcgtggacatcacgactgcaccatggacgtcagccagcaggccccggggcagagtggcatgggggcaggaatggtggttacaccaacggcatgagctcattttccaagatggatctagagcaggtcccacccacgcagaacgcgcctaatagtaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcggtgagcaccccggaccctcagtgtctgcggtggtcccggcccccgacccttgcatgcagaaagtccaacagccatggggctcgggagtcatccctggggtggaggccggtgggcggtgcctgccctaaggctcctggtcccctcgccccccagagagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449325 - DNA, 1076 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagcccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449326 - DNA, 594 bp, Homo sapiens
cagggctgtttgaaacacaggacagaatgctacacgcagaaggagtccccactcctgttaattgcagagaatgcagtaaaccccaagcacagcaatgaggggacgggatggaggaacagagaaagctaagggtagcctctgccctcctactccccaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagcccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449327 - DNA, 459 bp, Homo sapiens
acaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgcgccttgtctgcttgtgtgtttgtc

SEQ ID NO: 449328 - DNA, 1810 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449329 - DNA, 1264 bp, Homo sapiens
ggcggcggcacgagcggtggccgaggcagcgggatccagacccgggtccagcatatccagtaccagttccgcacagagacaaatggaggacaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449330 - DNA, 1888 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgcaaaaaaaaattcttcagaaataccagaggtcaccccatcaaatcctggagggggggcccggtacccattccgcccttt

SEQ ID NO: 449331 - DNA, 1328 bp, Homo sapiens
cagggctgtttgaaacacaggacagaatgctacacgcagaaggagtccccactcctgttaattgcagagaatgcagtaaaccccaagcacagcaatgaggggacgggatggaggaacagagaaagctaagggtagcctctgccctcctactccccaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449332 - DNA, 1244 bp, Homo sapiens
attaggcgcgttctgcgtctgtggggacgctcctagagagagtcggccgcagcgagggcacagacaggctcgtggacatcacgactgcaccatggacgtcagccagcaggccccggggcagagtggcatgggggcaggaatggtggttacaccaacggcatgagctcattttccaagatggatctagagcaggtcccacccacgcagaacgcgcctaatagtaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449333 - DNA, 2186 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccgctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgcaaaaaaaaaaaaaaaaaaaaaaaaaaaaaaaaaaaaaaaaggggggggcgcgcgcaaagactcatcccgcaggaggggcccacaggatcaacgccagcccccagcagttagtcggacacaaggaggggcccccatatatggggcggtgacaaattaatatgatgcgagagacggcggcgcacatactacaacaacaggcacgtcgagcaggcgagcaaacaggcacgaaacgcggaggagcacacctgcttgagagaaagaacacccacaaatcaacgcgggcgggaggggagcacccaacaggaggacaacaacaacccacccagcaagcgataataagataaacgcgcaggagaggaacacaatacaaacaacagacgcaacgggagatcatacggagggtagtcacacccacggacgcaaagatgcacagcggggatg

SEQ ID NO: 449334 - DNA, 1014 bp, Homo sapiens
tttcaaatctaatacttagcagatgcttgggcaaacagctctgcgataatacatgccccctttttttttcctcctcttgtagaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449335 - DNA, 1701 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcaggtgggtgcggggcctggagcgggtcagggcccaggagccccagatgcaaggcgctggccctcagctcccttgacctccgtcgtgtccgccagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449336 - DNA, 1764 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449337 - DNA, 2497 bp, Homo sapiens
cccagtgcagggcctggaccgtgctccatagcaagcactgatcttgggctattggttttggaggaaagagggagcacaaggatggaaggggccagggaagagaggtcacggtgggagaaggagagtccgcatccatcggagggtttgtcactcaggcctgagtgggaggcactggaggcagggagaggccagtcagcagcatgcggccacagcccagagaagccagaggggtttgctggtgggtgggccccagccttttcaagggaacggcaggtctggggagctgccgatctcggggtgtgagggtaacgggcaggctgtggcccacccctccttctcaggctcactggacccctgaccggtttcatcaccattatccaaggctttgaaaagaccccctggccttcctgccacatgtgccctagctatagggcttcgttcccctccacaaatggtgcagacagcatgagccaccctggcagggggctgggggtccgtggggtaggagttgggggtagctgagcgttctttcctgtccccacggtgcctggtgctggggcttggcagccagggttgggacagcctggctttagcaggtcctgagtcaggggtctcaggctccgcagcacacagtccccaggcaggtgtcaggatgggatgtggccagagaaaggcatgtgctctgtctggggatagctgccacccagctgacacagttggcatgagattgtggagttttatggagtaaaatcacaaatctgggttttttaagtaaaaccttctatgagttgccatctctggccttcaacataggatttgggtctttcctgggtgagctggtgctttgtgggccaggccctgggagctgcaagtaccagttgggatctgccattgccctgtggaaggattttaagcaggggtgaaacatggtcagacttggattctagagatgaggaaaacaaaacaaaatcacggtgccagagtctctggggagactggagaatgcagtgcaggggccgcaggagccaaaaaggggcactggtcctgcgaagagtggctctgtccatccctgccttccagtatgtgcccactgtgaccagagctccatttctcaaaagaagccagtgatgccaattaccatgagaaatttccttatttttaactgtcgattaaaatttgtacaagtatggtggggcaggcctgcaaaatgatctccaagtgcctggcctttgatgcccgtcctaaaagcatgtgtggcactggagggcccacgtttctttgttcctcttgagaagctggggtgggggccggctgggctcagggtgcggcccctcacttcccagggctgtggtctcggtggggcctgcactgttcctgggtgtcctcgggctgagcctctgccctgtgaggacggccgctcaggcatgagccgtcagcgaacccgtggctgtgactctgttttccgcagttggagcggaggcggagggacaagatcaacaactggatcgtccagctttcgaaaatcattccagactgtaacgcagacaacagcaagacgggagcggtgagcaccccggaccctcagtgtctgcggtggtcccggcccccgacccttgcatgcagaaagtccaacagccatggggctcgggagtcatccctggggtggaggccggtgggcggtgcctgccctaaggctcctggtcccctcgccccccagagagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449338 - DNA, 1164 bp, Homo sapiens
gcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 449339 - DNA, 819 bp, Homo sapiens
actttgcatccttcaatccaatcaaattttgacactcaatattaaccatcacagggttgtagagaggattcagaaatggtgctggtaaagcaaacagcaatagtgcttgggacacatgaaaccaataaagggtcatctgcctgaagctgctacctcagcatcatgcaatagcatcatcctcatctcctattgtcatcattaccattgccgttgtcttcatatgacatcatcactattagcaccgttgttttgtttcttctagctccagtagtctatgattccacaccacctcacattgttctttgaccataaatctgatttcctcagactgctagaattcttttcttgaatccccatggtggggaatgttctgcttatggcgaggtccaatgtccaagtttaatttcacccacctcactgggccatgatgttctggatgctgcgtggcaagtcagagatgtatttccccccttcagaaccaggtagaccgcagtttctgaaggcttaaggattcagagtggtttaagagcagtaaaccatggcccatcatcattgcataaggaagcaatgaaaggtgttggagtgtggatatgagtcatggaactctggggctatgttgctgccaggccctcaatggattggatggtgtccacctgcataattgaaggtggatcttctttactcagtcgactgattcaaatgctgatctcttccagcaacaccctcacagacacaccagaaataatgttttaccagctatctgtgtatcccttagcccagtaaaactgacacatacaattaactatcaaaaagccaata

SEQ ID NO: 449340 - DNA, 987 bp, Homo sapiens
actttgcatccttcaatccaatcaaattttgacactcaatattaaccatcacagggttgtagagaggattcagaaatggtgctggtaaagcaaacagcaatagtgcttgggacacatgaaaccaataaagggtcatctgcctgaagctgctacctcagcatcatgcaatagcatcatcctcatctcctattgtcatcattaccattgccgttgtcttcatatgacatcatcactattagcaccgttgttttgtttcttctagctccagtagtctatgattccacaccacctcacattgttctttgaccataaatctgatttcctcagactgctagaattcttttcttgaatccccatggtggggaatgttctgcttatggcgaggtccaatgtccaagtttaatttcacccacctcactgggccatgatgttctggatgctgcgtggcaagtcagagatgtatttccccccttcagaaccaggtagaccgcagtttctgaaggcttaaggattcagagtggtttaagagcagtaaaccatggcccatcatcattgcataaggaagcaatgaaaggcccagtccacaggctcatgtctggggccccgggggagtgagggcagcaaagaagaacagacaatgggctccacgcagacctctgcaacacactggagcctgagcccaatgctgcacgacccatcaactacaagaaggagggagaaggtgtatgaccccccctacacccgcaactctcccatgatctccatggacacccaaagatatacactgcagcacccagcaaagacgtggtacttggtgttggagtgtggatatgagtcatggaactctggggctatgttgctgccaggtaagaatctgttctaggaaggataaaatcaatggacatagaaaggcagactggagaagggaaagggagctgagccctgctgatagagtaaacctctggattaaactatgcctgaagccca

SEQ ID NO: 449341 - DNA, 506 bp, Homo sapiens
gaaatacatatatttctttatagagagttatatagaaagagatttattatgagcgattggctcatgtgactatggagactgagatgtcccatgctctgctgtctgcaagctggaggcccaggaaagcgggtggtgtagttcgacaatctgaagttgaaggccccaaaaccaggggtgccaatggtgtaagtcccactttgagtacaaaggcttgagagccagaatcactgatgttcgagggcagaagaagacagatgtcccagctcaagcagagagaaaattctccctttctctgactttttcgtctattcaggccctcaatggattggatggtgtccacctgcataattgaaggtggatcttctttactcagtcgactgattcaaatgctgatctcttccagcaacaccctcacagacacaccagaaataatgttttaccagctatctgtgtatcccttagcccagtaaaactgacacatacaattaactatcaaaaagccaata

SEQ ID NO: 449342 - DNA, 6147 bp, Homo sapiens
gcgggcgcgcgtcccgtccaggtccggagtaaccgccgccgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaaaaaatttttttaagtaattaaccgtttaaattttttcctaaagatttaacatgatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaatgcaggctcccaaattttaaattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttcagaaggcttcttgcttgttgacaagtaccgcaaaggctttattctggactggctatctcataaaaggatttctgtaagactttgcagtgtcattccctcagaacctaggtttgtttctaaagccacggtattgtccaggagcccctgtgtgtggggcaggtagctatccctcccatgtcattagtaatcctttaggatttaaggtacaactggacagcatcattccttccccttattgtgccaaatccccaccatcagccttgccattgccttaagatttgattattgcacccaattacctaaccactaaacagaaaggccaccttcactctttgaaaaaggcaagctgtgcttagaaacactgcttttaagagtagcacatttgagtgtgactttttccccccttcactatttcaaaatggttttgaaatggggtcttaaaggtaagcgccctcatacatgactgaaactttgtgagaggtcttatatttgaatggacccttaatgatttatgtgaaatagaatgaagtcctgtctctgtgagagaacgtgcctcctcactcatttgtctctgtctgttttcatagccatcaatatagtaacatatttactatattcttgaatacccttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctccacgtctgaggtcacctgccctgtgtggggcacaccaccgtcagcaccaccgtttttacagttactttggagctgctagactggttttctgtgttggtaaattgcctatataaatctgaataaaaaggatctgtacaaagaaaacaaa

SEQ ID NO: 449343 - DNA, 4918 bp, Homo sapiens
gcgggcgcgcgtcccgtccaggtccggagtaaccgccgccgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgttgaaacacacacacacacacacacacacacacacacacactccagaagcagaaaagccattgttcttaaagagtgaatgtcttcccagccctggttaattatagctgtgactgatgccgttcccgtctgcatctcaagctcataggttctcagcatgtgcagttgaggatgcgctgggcctcatgcctgttctagatctccaggataaagggcctgctgttgactccaccagggtctgggcttagcgtctaatatctcgtacctagggcgtgagctgcacaaacgtgttcagaaagattattcaactttcccatacttgttctaaaattgagctgatccgcatctctttcaaaaactagaatttctgctctaagaatagaacataaggctccactcccttttagaaaagatatatgaattggaaaatgctctgaaagtccttttgcttcaaacaaaagtgtaaacttttacacttccccaactcacatttgatttgtaatgatatggttgagaagtacatctagatgtcatttattaaaagtgctttgtaagactagattgagctgtttctgagggcggtcaccagttgtgttggggtctggtttgagtgccttctgccaaaatgttgtgatggaggtgtttctgcgaccagacacaggataccgctgtgtctgcacccggttgcctgcatggccagaggaaaagtcagttggattaaacatcatggtatacttggctgtgtttttttttaattttttaatattttgggatagggcctcgctctgtcacccaggctggagaacagtgggatgatcatggtcactgcggccttgaattcctaggttcaggcaatcctcccacgtcggcctcctgagtagctaggactgcaggtgcatgccacctttcctggctaattaatttgggtagagatggggtcttgaactcttaggctcaagtgatcctccttccttggcctcccaaaatgctggaattagagatgtaagccaccatgcccagccatagtacttggatgttttagaaggttttccaagtattacataattcctagatgttcacccttattacactccaactattaaaaaggtcaaaattcagcctatttttttt

SEQ ID NO: 449344 - DNA, 6804 bp, Homo sapiens
agcggggcgtgcgtggcgtggagtccagaatgagaagaaggaaagcggggccggttccttcaggacccgcctcagggggcaccgcggcggcttggggaccacttggagccccgtcctggggagaaaacagctcacgtctatggccctgactgcttaggcgggagctgcgtgcagctcagcttctccggggcatttttttctacacggttattgctctgtcacccaggctggagttcagcagtgcgatcttggctcattgcagccttgaacctcccgggctcaagtgatcctccctcctcaacctcccaagtagctgggactacagctgggtgagctatgaacaggccaactgcaagggcgagcagtttgtgtttgagaagggcgagtacgcccactgggactggtggaccagcagccagaggacagactcagcagcctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcatgtgggttggctactagtaccctggctaccgtgggctgcagtacctgctggagaagggagactacaaggacagcagcgactttggggcccgtcaccctcaggtgttggagtgtggatatgagtcatggaactctggggctatgttgctgccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgaaagaagttccttcatgatgtaggcatcataaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaaaaaatttttttaagtaattaaccgtttaaattttttcctaaagatttaacatgatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaatgcaggctcccaaattttaaattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttcagaaggcttcttgcttgttgacaagtaccgcaaaggctttattctggactggctatctcataaaaggatttctgtaagactttgcagtgtcattccctcagaacctaggtttgtttctaaagccacggtattgtccaggagcccctgtgtgtggggcaggtagctatccctcccatgtcattagtaatcctttaggatttaaggtacaactggacagcatcattccttccccttattgtgccaaatccccaccatcagccttgccattgccttaagatttgattattgcacccaattacctaaccactaaacagaaaggccaccttcactctttgaaaaaggcaagctgtgcttagaaacactgcttttaagagtagcacatttgagtgtgactttttccccccttcactatttcaaaatggttttgaaatggggtcttaaaggtaagcgccctcatacatgactgaaactttgtgagaggtcttatatttgaatggacccttaatgatttatgtgaaatagaatgaagtcctgtctctgtgagagaacgtgcctcctcactcatttgtctctgtctgttttcatagccatcaatatagtaacatatttactatattcttgaatacccttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctccacgtctgaggtcacctgccctgtgtggggcacaccaccgtcagcaccaccgtttttacagttactttggagctgctagactggttttctgtgttggtaaattgcctatataaatctgaataaaaaggatctgtacaaagaaaacaaa

SEQ ID NO: 449345 - DNA, 6681 bp, Homo sapiens
actttgcatccttcaatccaatcaaattttgacactcaatattaaccatcacagggttgtagagaggattcagaaatggtgctggtaaagcaaacagcaatagtgcttgggacacatgaaaccaataaagggtcatctgcctgaagctgctacctcagcatcatgcaatagcatcatcctcatctcctattgtcatcattaccattgccgttgtcttcatatgacatcatcactattagcaccgttgttttgtttcttctagctccagtagtctatgattccacaccacctcacattgttctttgaccataaatctgatttcctcagactgctagaattcttttcttgaatccccatggtggggaatgttctgcttatggcgaggtccaatgtccaagtttaatttcacccacctcactgggccatgatgttctggatgctgcgtggcaagtcagagatgtatttccccccttcagaaccaggtagaccgcagtttctgaaggcttaaggattcagagtggtttaagagcagtaaaccatggcccatcatcattgcataaggaagcaatgaaaggtgttggagtgtggatatgagtcatggaactctggggctatgttgctgccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgaaagaagttccttcatgatgtaggcatcataaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaaaaaatttttttaagtaattaaccgtttaaattttttcctaaagatttaacatgatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaatgcaggctcccaaattttaaattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttcagaaggcttcttgcttgttgacaagtaccgcaaaggctttattctggactggctatctcataaaaggatttctgtaagactttgcagtgtcattccctcagaacctaggtttgtttctaaagccacggtattgtccaggagcccctgtgtgtggggcaggtagctatccctcccatgtcattagtaatcctttaggatttaaggtacaactggacagcatcattccttccccttattgtgccaaatccccaccatcagccttgccattgccttaagatttgattattgcacccaattacctaaccactaaacagaaaggccaccttcactctttgaaaaaggcaagctgtgcttagaaacactgcttttaagagtagcacatttgagtgtgactttttccccccttcactatttcaaaatggttttgaaatggggtcttaaaggtaagcgccctcatacatgactgaaactttgtgagaggtcttatatttgaatggacccttaatgatttatgtgaaatagaatgaagtcctgtctctgtgagagaacgtgcctcctcactcatttgtctctgtctgttttcatagccatcaatatagtaacatatttactatattcttgaatacccttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctccacgtctgaggtcacctgccctgtgtggggcacaccaccgtcagcaccaccgtttttacagttactttggagctgctagactggttttctgtgttggtaaattgcctatataaatctgaataaaaaggatctgtacaaagaaaacaaa

SEQ ID NO: 449346 - DNA, 6070 bp, Homo sapiens
gcgggcgcgcgtcccgtccaggtccggagtaaccgccgccgccgccgccaaagctcgccaacatggcggacctggaggctgtgctggccgatgtcagttacctgatggccatggagaagagcaaggcgaccccggccgcccgcgccagcaagaggatcgtcctgccggagcccaggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaaaaaatttttttaagtaattaaccgtttaaattttttcctaaagatttaacatgatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaatgcaggctcccaaattttaaattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttcagaaggcttcttgcttgttgacaagtaccgcaaaggctttattctggactggctatctcataaaaggatttctgtaagactttgcagtgtcattccctcagaacctaggtttgtttctaaagccacggtattgtccaggagcccctgtgtgtggggcaggtagctatccctcccatgtcattagtaatcctttaggatttaaggtacaactggacagcatcattccttccccttattgtgccaaatccccaccatcagccttgccattgccttaagatttgattattgcacccaattacctaaccactaaacagaaaggccaccttcactctttgaaaaaggcaagctgtgcttagaaacactgcttttaagagtagcacatttgagtgtgactttttccccccttcactatttcaaaatggttttgaaatggggtcttaaaggtaagcgccctcatacatgactgaaactttgtgagaggtcttatatttgaatggacccttaatgatttatgtgaaatagaatgaagtcctgtctctgtgagagaacgtgcctcctcactcatttgtctctgtctgttttcatagccatcaatatagtaacatatttactatattcttgaatacccttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctccacgtctgaggtcacctgccctgtgtggggcacaccaccgtcagcaccaccgtttttacagttactttggagctgctagactggttttctgtgttggtaaattgcctatataaatctgaataaaaaggatctgtacaaagaaaacaaa

SEQ ID NO: 449347 - DNA, 5565 bp, Homo sapiens
gagagacatgaaggccaggccagaccgtgaagggcatcgccggccgatcttgaggagcctaaatgatctgactgcagttagaaaccaagtgttttaactagagagagaccataatcagccttgcagttcacaaagattgctccggctgcagtgtggaggattttcttcaacaacgacttcatggtcctgttttatcacagtttttttatggcgagttcctgcaaaatgactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaaaaaatttttttaagtaattaaccgtttaaattttttcctaaagatttaacatgatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaatgcaggctcccaaattttaaattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttcagaaggcttcttgcttgttgacaagtaccgcaaaggctttattctggactggctatctcataaaaggatttctgtaagactttgcagtgtcattccctcagaacctaggtttgtttctaaagccacggtattgtccaggagcccctgtgtgtggggcaggtagctatccctcccatgtcattagtaatcctttaggatttaaggtacaactggacagcatcattccttccccttattgtgccaaatccccaccatcagccttgccattgccttaagatttgattattgcacccaattacctaaccactaaacagaaaggccaccttcactctttgaaaaaggcaagctgtgcttagaaacactgcttttaagagtagcacatttgagtgtgactttttccccccttcactatttcaaaatggttttgaaatggggtcttaaaggtaagcgccctcatacatgactgaaactttgtgagaggtcttatatttgaatggacccttaatgatttatgtgaaatagaatgaagtcctgtctctgtgagagaacgtgcctcctcactcatttgtctctgtctgttttcatagccatcaatatagtaacatatttactatattcttgaatacccttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctccacgtctgaggtcacctgccctgtgtggggcacaccaccgtcagcaccaccgtttttacagttactttggagctgctagactggttttctgtgttggtaaattgcctatataaatctgaataaaaaggatctgtacaaagaaaacaaa

SEQ ID NO: 449348 - DNA, 2347 bp, Homo sapiens
gcgggcgcgcgtcccgtccaggtccggagtaaccgccgccgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgcta

SEQ ID NO: 449349 - DNA, 1398 bp, Homo sapiens
agcggggcgtgcgtggcgtggagtccagaatgagaagaaggaaagcggggccggttccttcaggacccgcctcagggggcaccgcggcggcttggggaccacttggagccccgtcctggggagaaaacagctcacgtctatggccctgactgcttaggcgggagctgcgtgcagctcagcttctccggggcatttttttctacacgctgggtgagctatgaacaggccaactgcaagggcgagcagtttgtgtttgagaagggcgagtacgcccactgggactggtggaccagcagccagaggacagactcagcagcctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcatgtgggttggctactagtaccctggctaccgtgggctgcagtacctgctggagaagggagactacaaggacagcagcgactttggggcccgtcaccctcagggacatggatgaagctggaaaccatcattctcagcaaactaacacagaagcagaaaaccaaacaccacatgttctcactcataagtgggagttgaacagtgagaacacatggacacaaggaggggaacatcacacaccgaggcctgtcagggagtgggggacaagagggagagagagcattgggacaaataccaaatgcatgcacggcttaaaacctagatgacaggttgatgggtgcagcaaaccaccatggcacatgtatacctgtgtaacaaacctgcacgttctgcacatgtatcccagaacttataataaaaaagaaaccagtaagtgctcaataaatgttactaacatctatttcttcattcattcttcaaccattacccactgagtgcctatttggatacttggcttagtacctgggtgatgaaataatctacagcaaacccccatggcatgagtttataacaaacctgcacatgtatccccgaacttaaaagttaaaaaaacagaatctgcacaagtctaagctacttccttgaggaaaagactcgagctgagatctcaaagaagagtagaagttgcaggggtaaagaggccaaagaagagtgtctcagatgagagcggcacgtgcaaaggccctgtggtgggaggagcctggtagctctgagaaactccacaaaggcacggtggtggctggaatgcagagatgtgggggcacattgaaaaccttgttaaagtgcttaaaatgattatcataaaggtagaaactaataagtgctaaataaatgttattctcgtccgtttctccaataaatat

SEQ ID NO: 449350 - DNA, 1854 bp, Homo sapiens
  misc_feature (1107)..(1107): n is a, c, g, or t
  misc_feature (1156)..(1156): n is a, c, g, or t
  misc_feature (1194)..(1194): n is a, c, g, or t
  misc_feature (1226)..(1226): n is a, c, g, or t
agcggggcgtgcgtggcgtggagtccagaatgagaagaaggaaagcggggccggttccttcaggacccgcctcagggggcaccgcggcggcttggggaccacttggagccccgtcctggggagaaaacagctcacgtctatggccctgactgcttaggcgggagctgcgtgcagctcagcttctccggggcatttttttctacacggttattgctctgtcacccaggctggagttcagcagtgcgatcttggctcattgcagccttgaacctcccgggctcaagtgatcctccctcctcaacctcccaagtagctgggactacagctgggtgagctatgaacaggccaactgcaagggcgagcagtttgtgtttgagaagggcgagtacgcccactgggactggtggaccagcagccagaggacagactcagcagcctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcatgtgggttggctactagtaccctggctaccgtgggctgcagtacctgctggagaagggagactacaaggacagcagcgactttggggcccgtcaccctcagatgttacagaagcacagagaggttaagtaacttgcccagtgctgcacggaaactaagtggtggagctgggatccgaacccaagctatctgactgtattgacaaacaaaagatgcatcaaaacccaaaagggcgagcgaggtattatggccattactggggagttagaaatttcttttcactggagagataaatggtgtttctgttccagattgtgaactggccatgcctggctctaggctttgggacagttcaactctgttccacatgtctgattctggatcccatgctgaagaggcagctgctgtataaggcatgttctttttgtgatgatggcagaagtttgagagacaagtcacactatgcaaacatggctcaagattctatcatacaacatctgctcgcattcaantggccaaagtcagtcaaggtcagtggggcagaaaagaatatactgcccnaaaaggaaggaaaaagtgagtgaacatgtgttgaacantactccaatttattatcggtaggtcaaggaanctttgcagcctgagtctcgtatggtgattctcaaacctcagcaaacatagatatcatctggggaatctggttcaaaatgcagacctgagactattctcctgcagaatatctgagtcagtggatttgggtggggcccaggaatctgcactttaaacagccactccctggggttattctgatactgatggtccagggtccacactttgagaatcactggtttaatggttctgagcatgtgctgagggctcagagatgcaagttcaaatcccagctccaccctagctttgaccttggtaagtagctttgcttttcagagcctcagttttctcctctaaaaaactgagttggccgggcgctgtggctcatgcctgtaatcccagcactttgggaggctgaggtgggcggatcatctgaggttgtgagtttgagaccagcctgaccaacatggagaaaccctgtctctactaaaaatacaaaattagccgggcatggtgatgcatgcctgtagtcccagctactagggaggctgaggcaggagaatcacttcaacctgggaggcggaggttgcggtgagctgagatcacgccattgcactccagcctgggcaacaagagcgaaactctgtctc

SEQ ID NO: 449351 - DNA, 1450 bp, Homo sapiens
agcggggcgtgcgtggcgtggagtccagaatgagaagaaggaaagcggggccggttccttcaggacccgcctcagggggcaccgcggcggcttggggaccacttggagccccgtcctggggagaaaacagctcacgtctatggccctgactgcttaggcgggagctgcgtgcagctcagcttctccggggcatttttttctacacggttattgctctgtcacccaggctggagttcagcagtgcgatcttggctcattgcagccttgaacctcccgggctcaagtgatcctccctcctcaacctcccaagtagctgggactacagctgggtgagctatgaacaggccaactgcaagggcgagcagtttgtgtttgagaagggcgagtacgcccactgggactggtggaccagcagccagaggacagactcagcagcctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcatgtgggttggctactagtaccctggctaccgtgggctgcagtacctgctggagaagggagactacaaggacagcagcgactttggggcccgtcaccctcagggacatggatgaagctggaaaccatcattctcagcaaactaacacagaagcagaaaaccaaacaccacatgttctcactcataagtgggagttgaacagtgagaacacatggacacaaggaggggaacatcacacaccgaggcctgtcagggagtgggggacaagagggagagagagcattgggacaaataccaaatgcatgcacggcttaaaacctagatgacaggttgatgggtgcagcaaaccaccatggcacatgtatacctgtgtaacaaacctgcacgttctgcacatgtatcccagaacttataataaaaaagaaaccagtaagtgctcaataaatgttactaacatctatttcttcattcattcttcaaccattacccactgagtgcctatttggatacttggcttagtacctgggtgatgaaataatctacagcaaacccccatggcatgagtttataacaaacctgcacatgtatccccgaacttaaaagttaaaaaaacagaatctgcacaagtctaagctacttccttgaggaaaagactcgagctgagatctcaaagaagagtagaagttgcaggggtaaagaggccaaagaagagtgtctcagatgagagcggcacgtgcaaaggccctgtggtggtaagggtggtatcaggctataccacccacacgtgaattctcatggaggtagtgcttttcttatactgtaaaatgtgaaggtgtatacctcgctcctctagcat

SEQ ID NO: 449352 - DNA, 1537 bp, Homo sapiens
agtgtatggtagagattcagtttttttttctttttggaagtccagtgtcttaaatcattcatgaaggagtccatttcctgcactgtggtcaatgtcgccttgctgatctatccccttccccacaggtggggtgattttatgggctgtcttttctgttcctgtagtctgtgtatccctgcactcttgccagattatgttaatgactattgctttgtagtcagtgttgaggtccctaaaacaggggccctccacccctgggcctcccgggcctcccgtggcctgggaatgggggctccacagcaggaggtggggattacagcctgagccccgcctcccgtcagaccagcggcagtattagattctcataggggtgcaaaccctattgtgaactgcacatggaaaggatctaggttgcatgctccaatgagaatctaatgtcccctgcccacagcccgtgaaaaattgtcttccacaaaatcaatccctggtgccaaaacatttggccctataacatgattcttcaggaatgttttaggtattcttgcccttttaggactccatttagaagcatcccctcacatttggaaaagtggaaaaccttgttgaatgagctgaagtggttaaaatgattatcataaaggtagaaaccagtaagtgctccatatacaccatggaatactatgcagccataaaaaaatgagttcatgtcctttgcagggacatggatgaagctggaaaccatcattctcagcaaactaacacagaagcagaaaaccaaacaccacatgttctcactcataagtgggagttgaacagtgagaacacatggacacaaggaggggaacatcacacaccgaggcctgtcagggagtgggggacaagagggagagagagcattgggacaaataccaaatgcatgcacggcttaaaacctagatgacaggttgatgggtgcagcaaaccaccatggcacatgtatacctgtgtaacaaacctgcacgttctgcacatgtatcccagaacttataataaaaaagaaaccagtaagtgctcaataaatgttactaacatctatttcttcattcattcttcaaccattacccactgagtgcctatttggatacttggcttagtacctgggtgatgaaataatctacagcaaacccccatggcatgagtttataacaaacctgcacatgtatccccgaacttaaaagttaaaaaaacagaatctgcacaagtctaagctacttccttgaggaaaagactcgagctgagatctcaaagaagagtagaagttgcaggggtaaagaggccaaagaagagtgtctcagatgagagcggcacgtgcaaaggccctgtggtgggaggagcctggtagctctgagaaactccacaaaggcacggtggtggctggaatgcagagatgtgggggcacattgaaaaccttgttaaagtgcttaaaatgattatcataaaggtagaaactaataagtgctaaataaatgttattctcgtccgtttctccaataaatat

SEQ ID NO: 449353 - DNA, 858 bp, Homo sapiens
agcggggcgtgcgtggcgtggagtccagaatgagaagaaggaaagcggggccggttccttcaggacccgcctcagggggcaccgcggcggcttggggaccacttggagccccgtcctggggagaaaacagctcacgtctatggccctgactgcttaggcgggagctgcgtgcagctcagcttctccggggcatttttttctacacggttattgctctgtcacccaggctggagttcagcagtgcgatcttggctcattgcagccttgaacctcccgggctcaagtgatcctccctcctcaacctcccaagtagctgggactacagctgggtgagctatgaacaggccaactgcaagggcgagcagtttgtgtttgagaagggcgagtacgcccactgggactggtggaccagcagccagaggacagactcagcagcctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcatgtgggttggctactagtaccctggctaccgtgggctgcagtacctgctggagaagggagactacaaggacagcagcgactttggggcccgtcaccctcaggtacagtccgtgcgctgcatccacgacatgcaggggcaccaatgtggtgccttccacccctccaactagtgcccaccccaccatgcctccttcccaggacccaggtctgctgcccaggaaccctccagacctcccagagagtgaataaagtgtgacttgca

SEQ ID NO: 449354 - DNA, 732 bp, Homo sapiens
atcagaaatttcacactagaaaagtgtacctaacttgattcaagtgtgagctcttggaccagggagtgggggacaagagggagagagagcattgggacaaataccaaatgcatgcacggcttaaaacctagatgacaggttgatgggtgcagcaaaccaccatggcacatgtatacctgtgtaacaaacctgcacgttctgcacatgtatcccagaacttataataaaaaagaaaccagtaagtgctcaataaatgttactaacatctatttcttcattcattcttcaaccattacccactgagtgcctatttggatacttggcttagtacctgggtgatgaaataatctacagcaaacccccatggcatgagtttataacaaacctgcacatgtatccccgaacttaaaagttaaaaaaacagaatctgcacaagtctaagctacttccttgaggaaaagactcgagctgagatctcaaagaagagtagaagttgcaggggtaaagaggccaaagaagagtgtctcagatgagagcggcacgtgcaaaggccctgtggtgggaggagcctggtagctctgagaaactccacaaaggcacggtggtggctggaatgcagagatgtgggggcacattgaaaaccttgttaaagtgcttaaaatgattatcataaaggtagaaactaataagtgctaaataaatgttattctcgtccgtttctccaataaatat

SEQ ID NO: 449355 - DNA, 739 bp, Homo sapiens
agcggggcgtgcgtggcgtggagtccagaatgagaagaaggaaagcggggccggttccttcaggacccgcctcagggggcaccgcggcggcttggggaccacttggagccccgtcctggggagaaaacagctcacgtctatggccctgactgcttaggcgggagctgcgtgcagctcagcttctccggggcatttttttctacacgctgggtgagctatgaacaggccaactgcaagggcgagcagtttgtgtttgagaagggcgagtacgcccactgggactggtggaccagcagccagaggacagactcagcagcctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcatgtgggttggctactagtaccctggctaccgtgggctgcagtacctgctggagaagggagactacaaggacagcagcgactttggggcccgtcaccctcaggtacagtccgtgcgctgcatccacgacatgcaggggcaccaatgtggtgccttccacccctccaactagtgcccaccccaccatgcctccttcccaggacccaggtctgctgcccaggaaccctccagacctcccagagagtgaataaagtgtgacttgca

SEQ ID NO: 449356 - DNA, 1143 bp, Homo sapiens
agcggggcgtgcgtggcgtggagtccagaatgagaagaaggaaagcggggccggttccttcaggacccgcctcagggggcaccgcggcggcttggggaccacttggagccccgtcctggggagaaaacagctcacgtctatggccctgactgcttaggcgggagctgcgtgcagctcagcttctccggggcatttttttctacacggttattgctctgtcacccaggctggagttcagcagtgcgatcttggctcattgcagccttgaacctcccgggctcaagtgatcctccctcctcaacctcccaagtagctgggactacagctgggtgagctatgaacaggccaactgcaagggcgagcagtttgtgtttgagaagggcgagtacgcccactgggactggtggaccagcagccagaggacagactcagcagcctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcatgtgggttggctactagtaccctggctaccgtgggctgcagtacctgctggagaagggagactacaaggacagcagcgactttggggcccgtcaccctcaggtgttggagtgtggatatgagtcatggaactctggggctatgttgctgccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagaggtaagaagtaactgttttactgatgcttttctttcaaaagcatatttaaactgtactttggaacatattaagactacttaatatcttacaaatatttagaaattcattgaaagtaattagtagtgcaaaatatagtatcaagtttgagatgctaacaggtatgaaaagctgagtatgccataaaagtcgcattcttaaaggcttcagagtgctatggaagcaatgagggacagttggactaaa

SEQ ID NO: 449357 - DNA, 1020 bp, Homo sapiens
agcggggcgtgcgtggcgtggagtccagaatgagaagaaggaaagcggggccggttccttcaggacccgcctcagggggcaccgcggcggcttggggaccacttggagccccgtcctggggagaaaacagctcacgtctatggccctgactgcttaggcgggagctgcgtgcagctcagcttctccggggcatttttttctacacggacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcatgtgggttggctactagtaccctggctaccgtgggctgcagtacctgctggagaagggagactacaaggacagcagcgactttggggcccgtcaccctcaggtacagtccgtgcgctgcatccacgacatgcaggggcaccaatgtggtgccttccacccctccaactagtgcccaccccaccatgcctccttcccaggacccaggtctgctgcccaggaaccctccagacctcccagagagtgaataaagtgtgacttgcaacttgtctgctgtgggtctttgatctcccctggcagctggtgtgtgtgtgtgtgtgtgtgtgtgtgcgtgcgtgtgtgtgatagaaatgagaattggcaagtatctgggctatgagtagggcaacagaacccttactgagtcttacggttctgcagcttcttagctcttaactgtgtgaccttggacacagtgcccaacctctctgagcctttgtttcttcacctgacttgcaattcccttgcctctgagtgtctggctggtctcgaacccctgaacttgtgatctgcctgcctcagcctcccaaaatgctgggattacaggcgtgagccactgcacctggccaaacttgaagaaattatttctaatccccggtcacaaagaaattccctaatagatttttttctctaaa

SEQ ID NO: 449358 - DNA, 1059 bp, Homo sapiens
actttgcatccttcaatccaatcaaattttgacactcaatattaaccatcacagggttgtagagaggattcagaaatggtgctggtaaagcaaacagcaatagtgcttgggacacatgaaaccaataaagggtcatctgcctgaagctgctacctcagcatcatgcaatagcatcatcctcatctcctattgtcatcattaccattgccgttgtcttcatatgacatcatcactattagcaccgttgttttgtttcttctagctccagtagtctatgattccacaccacctcacattgttctttgaccataaatctgatttcctcagactgctagaattcttttcttgaatccccatggtggggaatgttctgcttatggcgaggtccaatgtccaagtttaatttcacccacctcactgggccatgatgttctggatgctgcgtggcaagtcagagatgtatttccccccttcagaaccaggtagaccgcagtttctgaaggcttaaggattcagagtggtttaagagcagtaaaccatggcccatcatcattgcataaggaagcaatgaaaggcccagtccacaggctcatgtctggggccccgggggagtgagggcagcaaagaagaacagacaatgggctccacgcagacctctgcaacacactggagcctgagcccaatgctgcacgacccatcaactacaagaaggagggagaaggtgtatgaccccccctacacccgcaactctcccatgatctccatggacacccaaagatatacactgcagcacccagcaaagacgtggtacttggtgttggagtgtggatatgagtcatggaactctggggctatgttgctgccaggccctcaatggattggatggtgtccacctgcataattgaaggtggatcttctttactcagtcgactgattcaaatgctgatctcttccagcaacaccctcacagacacaccagaaataatgttttaccagctatctgtgtatcccttagcccagtaaaactgacacatacaattaactatcaaaaagccaata

SEQ ID NO: 449359 - DNA, 476 bp, Homo sapiens
gtgagcctgtcacaacggctgcctttgtattccccctcagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaa

SEQ ID NO: 449360 - DNA, 417 bp, Homo sapiens
ttgagtatgactatgtcctaggcagtggggatataaaggagaataacataacaccatctattggagacaccaatgagaaaaccagaattgtagttcaacgcaataaaggctatgctggtaatacttgtgataatccctgaaccaactggtatggccaatcataggcatgagatctcagctagtccagtcagagtgaatctcagagctctttactgtctaaaaagcttgttcttttttcttctaggtgttggagtgtggatatgagtcatggaactctggggctatgttgctgccaggtaagaatctgttctaggaaggataaaatcaatggacatagaaaggcagactggagaagggaaagggagctgagccctgctgatagagtaaacctctggattaaactatgcctgaagccca

SEQ ID NO: 449361 - DNA, 546 bp, Homo sapiens
ccatacatagaagaaatttgtgaaagccttcgaggtgacatttttcaaaaatttatggaaaggtatgaaactttatgcatatatatacacaattttttatcatgtacgtgtacctcatcttatgccgtaaatgctgaccttaaaatgtgtgttaatcatttagcaagtattcactgaccatgtacgatgtgccaggctttgtgttaaactgtttcctcagtactttacattataattttagggtttgtctatcttaacatctctttgaccttcaatttctcagcttcaatagagtctaaaatatacactgaggaacctcaattttaaaaagtatcttattgagagacctttgctaataatgcaaacttgactataatttatctgattcatttgcttggattttggaaacatgtctcccaaagcaggacaagcctgtacttgattcttcatgtaggagtagaatttaaggacataggtcaatgtctgtttatgatcgtgtacatcattaaatacctaataaatatgtcccttggttactcaaactat

SEQ ID NO: 449362 - DNA, 6093 bp, Homo sapiens
gcgggcgcgcgtcccgtccaggtccggagtaaccgccgccgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaatgcaggctcccaaattttaaattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttcagaaggcttcttgcttgttgacaagtaccgcaaaggctttattctggactggctatctcataaaaggatttctgtaagactttgcagtgtcattccctcagaacctaggtttgtttctaaagccacggtattgtccaggagcccctgtgtgtggggcaggtagctatccctcccatgtcattagtaatcctttaggatttaaggtacaactggacagcatcattccttccccttattgtgccaaatccccaccatcagccttgccattgccttaagatttgattattgcacccaattacctaaccactaaacagaaaggccaccttcactctttgaaaaaggcaagctgtgcttagaaacactgcttttaagagtagcacatttgagtgtgactttttccccccttcactatttcaaaatggttttgaaatggggtcttaaaggtaagcgccctcatacatgactgaaactttgtgagaggtcttatatttgaatggacccttaatgatttatgtgaaatagaatgaagtcctgtctctgtgagagaacgtgcctcctcactcatttgtctctgtctgttttcatagccatcaatatagtaacatatttactatattcttgaatacccttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctccacgtctgaggtcacctgccctgtgtggggcacaccaccgtcagcaccaccgtttttacagttactttggagctgctagactggttttctgtgttggtaaattgcctatataaatctgaataaaaaggatctgtacaaagaaaacaaa

SEQ ID NO: 449363 - DNA, 4346 bp, Homo sapiens
gcgggcgcgcgtcccgtccaggtccggagtaaccgccgccgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgttgaaacacacacacacacacacacacacacacacacacactccagaagcagaaaagccattgttcttaaagagtgaatgtcttcccagccctggttaattatagctgtgactgatgccgttcccgtctgcatctcaagctcataggttctcagcatgtgcagttgaggatgcgctgggcctcatgcctgttctagatctccaggataaagggcctgctgttgactccaccagggtctgggcttagcgtctaatatctcgtacctagggcgtgagctgcacaaacgtgttcagaaagattattcaactttcccatacttgttctaaaattgagctgatccgcatctctttcaaaaactagaatttctgctctaagaatagaacataaggctccactcccttttagaaaagatatatgaattggaaaatgctctgaaagtccttttgcttcaaacaaaagtgtaaacttttacacttccccaactcacatttgatttgtaatgatatggttgagaagtacatctagatgtcatttattaaaagtgctttgtaagacta

SEQ ID NO: 449364 - DNA, 6685 bp, Homo sapiens
agcggggcgtgcgtggcgtggagtccagaatgagaagaaggaaagcggggccggttccttcaggacccgcctcagggggcaccgcggcggcttggggaccacttggagccccgtcctggggagaaaacagctcacgtctatggccctgactgcttaggcgggagctgcgtgcagctcagcttctccggggcatttttttctacacgctgggtgagctatgaacaggccaactgcaagggcgagcagtttgtgtttgagaagggcgagtacgcccactgggactggtggaccagcagccagaggacagactcagcagcctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcatgtgggttggctactagtaccctggctaccgtgggctgcagtacctgctggagaagggagactacaaggacagcagcgactttggggcccgtcaccctcaggtgttggagtgtggatatgagtcatggaactctggggctatgttgctgccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgaaagaagttccttcatgatgtaggcatcataaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaaaaaatttttttaagtaattaaccgtttaaattttttcctaaagatttaacatgatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaatgcaggctcccaaattttaaattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttcagaaggcttcttgcttgttgacaagtaccgcaaaggctttattctggactggctatctcataaaaggatttctgtaagactttgcagtgtcattccctcagaacctaggtttgtttctaaagccacggtattgtccaggagcccctgtgtgtggggcaggtagctatccctcccatgtcattagtaatcctttaggatttaaggtacaactggacagcatcattccttccccttattgtgccaaatccccaccatcagccttgccattgccttaagatttgattattgcacccaattacctaaccactaaacagaaaggccaccttcactctttgaaaaaggcaagctgtgcttagaaacactgcttttaagagtagcacatttgagtgtgactttttccccccttcactatttcaaaatggttttgaaatggggtcttaaaggtaagcgccctcatacatgactgaaactttgtgagaggtcttatatttgaatggacccttaatgatttatgtgaaatagaatgaagtcctgtctctgtgagagaacgtgcctcctcactcatttgtctctgtctgttttcatagccatcaatatagtaacatatttactatattcttgaatacccttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctccacgtctgaggtcacctgccctgtgtggggcacaccaccgtcagcaccaccgtttttacagttactttggagctgctagactggttttctgtgttggtaaattgcctatataaatctgaataaaaaggatctgtacaaagaaaacaaa

SEQ ID NO: 449365 - DNA, 6089 bp, Homo sapiens
gcgggcgcgcgtcccgtccaggtccggagtaaccgccgccgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgatccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaaaaaatttttttaagtaattaaccgtttaaattttttcctaaagatttaacatgatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaatgcaggctcccaaattttaaattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttcagaaggcttcttgcttgttgacaagtaccgcaaaggctttattctggactggctatctcataaaaggatttctgtaagactttgcagtgtcattccctcagaacctaggtttgtttctaaagccacggtattgtccaggagcccctgtgtgtggggcaggtagctatccctcccatgtcattagtaatcctttaggatttaaggtacaactggacagcatcattccttccccttattgtgccaaatccccaccatcagccttgccattgccttaagatttgattattgcacccaattacctaaccactaaacagaaaggccaccttcactctttgaaaaaggcaagctgtgcttagaaacactgcttttaagagtagcacatttgagtgtgactttttccccccttcactatttcaaaatggttttgaaatggggtcttaaaggtaagcgccctcatacatgactgaaactttgtgagaggtcttatatttgaatggacccttaatgatttatgtgaaatagaatgaagtcctgtctctgtgagagaacgtgcctcctcactcatttgtctctgtctgttttcatagccatcaatatagtaacatatttactatattcttgaatacccttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctccacgtctgaggtcacctgccctgtgtggggcacaccaccgtcagcaccaccgtttttacagttactttggagctgctagactggttttctgtgttggtaaattgcctatataaatctgaataaaaaggatctgtacaaagaaaacaaa

SEQ ID NO: 449366 - DNA, 5035 bp, Homo sapiens
tgtgtgtgtgtgtgtctgtgtgtgtgtgtgtgtgtgtgtgggttttttgtgttgttttgtgttgttttttgagacacagtctcactctgtagcccagagctggagtgcactggggcaatctcggcgtactcgcacacacatgtgtacgagtaggtgtgtgtgtgtgtgtgtgtgtgtgtgtgtgtgtgtgtgtgcaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaaaaaatttttttaagtaattaaccgtttaaattttttcctaaagatttaacatgatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaatgcaggctcccaaattttaaattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttcagaaggcttcttgcttgttgacaagtaccgcaaaggctttattctggactggctatctcataaaaggatttctgtaagactttgcagtgtcattccctcagaacctaggtttgtttctaaagccacggtattgtccaggagcccctgtgtgtggggcaggtagctatccctcccatgtcattagtaatcctttaggatttaaggtacaactggacagcatcattccttccccttattgtgccaaatccccaccatcagccttgccattgccttaagatttgattattgcacccaattacctaaccactaaacagaaaggccaccttcactctttgaaaaaggcaagctgtgcttagaaacactgcttttaagagtagcacatttgagtgtgactttttccccccttcactatttcaaaatggttttgaaatggggtcttaaaggtaagcgccctcatacatgactgaaactttgtgagaggtcttatatttgaatggacccttaatgatttatgtgaaatagaatgaagtcctgtctctgtgagagaacgtgcctcctcactcatttgtctctgtctgttttcatagccatcaatatagtaacatatttactatattcttgaatacccttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctccacgtctgaggtcacctgccctgtgtggggcacaccaccgtcagcaccaccgtttttacagttactttggagctgctagactggttttctgtgttggtaaattgcctatataaatctgaataaaaaggatctgtacaaagaaaacaaa

SEQ ID NO: 449367 - DNA, 1517 bp, Homo sapiens
agcggggcgtgcgtggcgtggagtccagaatgagaagaaggaaagcggggccggttccttcaggacccgcctcagggggcaccgcggcggcttggggaccacttggagccccgtcctggggagaaaacagctcacgtctatggccctgactgcttaggcgggagctgcgtgcagctcagcttctccggggcatttttttctacacggttattgctctgtcacccaggctggagttcagcagtgcgatcttggctcattgcagccttgaacctcccgggctcaagtgatcctccctcctcaacctcccaagtagctgggactacagctgggtgagctatgaacaggccaactgcaagggcgagcagtttgtgtttgagaagggcgagtacgcccactgggactggtggaccagcagccagaggacagactcagcagcctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcatgtgggttggctactagtaccctggctaccgtgggctgcagtacctgctggagaagggagactacaaggacagcagcgactttggggcccgtcaccctcagggacatggatgaagctggaaaccatcattctcagcaaactaacacagaagcagaaaaccaaacaccacatgttctcactcataagtgggagttgaacagtgagaacacatggacacaaggaggggaacatcacacaccgaggcctgtcagggagtgggggacaagagggagagagagcattgggacaaataccaaatgcatgcacggcttaaaacctagatgacaggttgatgggtgcagcaaaccaccatggcacatgtatacctgtgtaacaaacctgcacgttctgcacatgtatcccagaacttataataaaaaagaaaccagtaagtgctcaataaatgttactaacatctatttcttcattcattcttcaaccattacccactgagtgcctatttggatacttggcttagtacctgggtgatgaaataatctacagcaaacccccatggcatgagtttataacaaacctgcacatgtatccccgaacttaaaagttaaaaaaacagaatctgcacaagtctaagctacttccttgaggaaaagactcgagctgagatctcaaagaagagtagaagttgcaggggtaaagaggccaaagaagagtgtctcagatgagagcggcacgtgcaaaggccctgtggtgggaggagcctggtagctctgagaaactccacaaaggcacggtggtggctggaatgcagagatgtgggggcacattgaaaaccttgttaaagtgcttaaaatgattatcataaaggtagaaactaataagtgctaaataaatgttattctcgtccgtttctccaataaatat

SEQ ID NO: 449368 - DNA, 1268 bp, Homo sapiens
agcggggcgtgcgtggcgtggagtccagaatgagaagaaggaaagcggggccggttccttcaggacccgcctcagggggcaccgcggcggcttggggaccacttggagccccgtcctggggagaaaacagctcacgtctatggccctgactgcttaggcgggagctgcgtgcagctcagcttctccggggcatttttttctacacggttattgctctgtcacccaggctggagttcagcagtgcgatcttggctcattgcagccttgaacctcccgggctcaagtgatcctccctcctcaacctcccaagtagctgggactacagctgggtgagctatgaacaggccaactgcaagggcgagcagtttgtgtttgagaagggcgagtacgcccactgggactggtggaccagcagccagaggacagactcagcagcctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcatgtgggttggctactagtaccctggctaccgtgggctgcagtacctgctggagaagggagactacaaggacagcagcgactttggggcccgtcaccctcaggtacagtccgtgcgctgcatccacgacatgcaggggcaccaatgtggtgccttccacccctccaactagtgcccaccccaccatgcctccttcccaggacccaggtctgctgcccaggaaccctccagacctcccagagagtgaataaagtgtgacttgcaacttgtctgctgtgggtctttgatctcccctggcagctggtgtgtgtgtgtgtgtgtgtgtgtgtgcgtgcgtgtgtgtgatagaaatgagaattggcaagtatctgggctatgagtagggcaacagaacccttactgagtcttacggttctgcagcttcttagctcttaactgtgtgaccttggacacagtgcccaacctctctgagcctttgtttcttcacctgacttgcaattcccttgcctctgagtgtctggctggtctcgaacccctgaacttgtgatctgcctgcctcagcctcccaaaatgctgggattacaggcgtgagccactgcacctggccaaacttgaagaaattatttctaatccccggtcacaaagaaattccctaatagatttttttctctaaa

SEQ ID NO: 449369 - DNA, 1631 bp, Homo sapiens
ttttttttctcctccgcacagaagtcgcgctcgggcagcctgcgcgctcgcagcaggaaccaggctccaggcgccggcgccggggccgcggggaggaggcgacttcgctccctgcggcgggcgcggcccgggcgcccgagcctcctcggccttggagagcagcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcggaaggcagcatccctgcatgccgtccatatacaacccctctttgaaaaaagacacagagaataaactcctacgaaagccctacattgagctccaatctgctcggggtgggacgggtgcttcccacacctgaccccacccttctttcctaccagcccagagccttgtggcttgtacagttttgaaactcccgttctattttatgatggttgataatagtcagtaacctaataaaggaacgtttgttaaaatatcaaaaaaattgaa

SEQ ID NO: 449370 - DNA, 2200 bp, Homo sapiens
ttttttttctcctccgcacagaagtcgcgctcgggcagcctgcgcgctcgcagcaggaaccaggctccaggcgccggcgccggggccgcggggaggaggcgacttcgctccctgcggcgggcgcggcccgggcgcccgagcctcctcggccttggagagcagcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtccctggtcttccctcatcctccgtggctgcctccatgggacaaggaccgattccaacacaggctcctctttcccccttcccgacatcagcggaaggcagcatccctgcatgccgtccatatacaacccctctttgaaaaaagacacagagaataaactcctacgaaagccctacattgagctccaatctgctcggggtgggacgggtgcttcccacacctctgggagaaggctgcagccacctgggggtcccagggtggtgggggtggcaggtggtaccacagctctgagagcagataccaggggtactaagaggtgcttagacaagggctggtgcccggcccagggtgcccagcggggccatgccatggcagataaagctcaggacgtcaaaaactcaccatggaccccaaggcagaaaccaagaactgtctgcaggcaaataagcacccagcacccatcctggctgccggtgccccgtaccctgtatttattcttttaacaataacaaaagccatttatttattccatctagaaaggaaaccctgtttcagtcccctctctctggctgttctgttactttccttccacctgtgccctccctgggatatgtatgcctcgcccgccctccctgggcacatgtgcacacgtgcccaggcacaagtatgtctctgggtcccttgccctgcagtttccagggggctctgctccaagttccctagcgggcccctcagggagaaatagcctcacgtgcaatctgggtgtcttcgggggcccgtctggaagggctgcagcaattcccctgtgtctccaggtaaccagctaactcttgggctcaggcacccttgcacagggttgcatttctttagtcttctgtgggtcttttgatgtgggtttgattttgcttttgcttttctagctgagatttcccaagtgcatcctcagaagctctgggtgtgccagaggacccccagaactaagaagggagggcgagtgggtctccattccccgagaagccaggggcagggtgggatggggaagaccaggagcagagtcgagcctcacagaagccagcgcgggtctctgctcagcaccccagccggggctctggacccagggtaacagccccagttcatcccaacccctctcagagcctcaagaggggtagctcggctgccggaagagaggggtgccctatccctggcaacccctccacgtagcgtaccccagcacctgccaccgcctttgccatttctttgagcttgaagttaactctcttagagtctaactttggttcatttctgcacaggtacaatagatgactttatttgtttaaaatgtttaatatatatacatacatatatatatatttgtctgtaagaattatgttttaaacagctgctgtagagtacctttttttaagtaaatcttacagtggagtatattttttaaagcacaaaattggtgccaagactgggtgagaaatgtacattacccccttattattttgacggtttttttttttcggggcaggggaccttacctgtaagacttttaaagattttcctccctcctgtttcaggtgggtcacattctgatgaatgtttcccttgtacagatcccagcttatggccttgacccagccgtcctcacagatgccgggtgaccctctagctctctctgcatctcccaccccccgacaccctgggaccctcgaccccacccttctttcctaccagcccagagccttgtggcttgtacagttttgaaactcccgttctattttatgatggttgataatagtcagtaacctaataaaggaacgtttgttaaaatatcaaaaaaattgaa

SEQ ID NO: 449371 - DNA, 3070 bp, Homo sapiens
ttttttttctcctccgcacagaagtcgcgctcgggcagcctgcgcgctcgcagcaggaaccaggctccaggcgccggcgccggggccgcggggaggaggcgacttcgctccctgcggcgggcgcggcccgggcgcccgagcctcctcggccttggagagcagcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcggaaggcagcatccctgcatgccgtccatatacaacccctctttgaaaaaagacacagagaataaactcctacgaaagccctacattgagctccaatctgctcggggtgggacgggtgcttcccacacctctgggagaaggctgcagccacctgggggtcccagggtggtgggggtggcaggtggtaccacagctctgagagcagataccaggggtactaagaggtgcttagacaagggctggtgcccggcccagggtgcccagcggggccatgccatggcagataaagctcaggacgtcaaaaactcaccatggaccccaaggcagaaaccaagaactgtctgcaggcaaataagcacccagcacccatcctggctgccggtgccccgtaccctgtatttattcttttaacaataacaaaagccatttatttattccatctagaaaggaaaccctgtttcagtcccctctctctggctgttctgttactttccttccacctgtgccctccctgggatatgtatgcctcgcccgccctccctgggcacatgtgcacacgtgcccaggcacaagtatgtctctgggtcccttgccctgcagtttccagggggctctgctccaagttccctagcgggcccctcagggagaaatagcctcacgtgcaatctgggtgtcttcgggggcccgtctggaagggctgcagcaattcccctgtgtctccaggtaaccagctaactcttgggctcaggcacccttgcacagggttgcatttctttagtcttctgtgggtcttttgatgtgggtttgattttgcttttgcttttctagctgagatttcccaagtgcatcctcagaagctctgggtgtgccagaggacccccagaactaagaagggagggcgagtgggtctccattccccgagaagccaggggcagggtgggatggggaagaccaggagcagagtcgagcctcacagaagccagcgcgggtctctgctcagcaccccagccggggctctggacccagggtaacagccccagttcatcccaacccctctcagagcctcaagaggggtagctcggctgccggaagagaggggtgccctatccctggcaacccctccacgtagcgtaccccagcacctgccaccgcctttgccatttctttgagcttgaagttaactctcttagagtctaactttggttcatttctgcacaggtacaatagatgactttatttatgttttaaacagctgctgtagagtacctttttttaagtaaatcttacagtggagtatattttttaaagcacaaaattggtgccaagactgggtgagaaatgtacattacccccttattattttgacggtttttttttttcggggcaggggaccttacctgtaagacttttaaagattttcctccctcctgtttcaggtgggtcacattctgatgaatgtttcccttgtacagatcccagcttatggccttgacccagccgtcctcacagatgccgggtgaccctctagctctctctgcatctcccaccccccgacaccctgggaccctcgaccccacccttctttcctaccagcccagagccttgtggcttgtacagttttgaaactcccgttctattttatgatggttgataatagtcagtaacctaataaaggaacgtttgttaaaatatcaaaaaaattgaa

SEQ ID NO: 449372 - DNA, 3179 bp, Homo sapiens
ttttttttctcctccgcacagaagtcgcgctcgggcagcctgcgcgctcgcagcaggaaccaggctccaggcgccggcgccggggccgcggggaggaggcgacttcgctccctgcggcgggcgcggcccgggcgcccgagcctcctcggccttggagagcagcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcggaaggcagcatccctgcatgccgtccatatacaacccctctttgaaaaaagacacagagaataaactcctacgaaagccctacattgagctccaatctgctcggggtgggacgggtgcttcccacacctctgggagaaggctgcagccacctgggggtcccagggtggtgggggtggcaggtggtaccacagctctgagagcagataccaggggtactaagaggtgcttagacaagggctggtgcccggcccagggtgcccagcggggccatgccatggcagataaagctcaggacgtcaaaaactcaccatggaccccaaggcagaaaccaagaactgtctgcaggcaaataagcacccagcacccatcctggctgccggtgccccgtaccctgtatttattcttttaacaataacaaaagccatttatttattccatctagaaaggaaaccctgtttcagtcccctctctctggctgttctgttactttccttccacctgtgccctccctgggatatgtatgcctcgcccgccctccctgggcacatgtgcacacgtgcccaggcacaagtatgtctctgggtcccttgccctgcagtttccagggggctctgctccaagttccctagcgggcccctcagggagaaatagcctcacgtgcaatctgggtgtcttcgggggcccgtctggaagggctgcagcaattcccctgtgtctccaggtaaccagctaactcttgggctcaggcacccttgcacagggttgcatttctttagtcttctgtgggtcttttgatgtgggtttgattttgcttttgcttttctagctgagatttcccaagtgcatcctcagaagctctgggtgtgccagaggacccccagaactaagaagggagggcgagtgggtctccattccccgagaagccaggggcagggtgggatggggaagaccaggagcagagtcgagcctcacagaagccagcgcgggtctctgctcagcaccccagccggggctctggacccagggtaacagccccagttcatcccaacccctctcagagcctcaagaggggtagctcggctgccggaagagaggggtgccctatccctggcaacccctccacgtagcgtaccccagcacctgccaccgcctttgccatttctttgagcttgaagttaactctcttagagtctaactttggttcatttctgcacaggtacaatagatgactttatttgtttaaaatgtttaatatatatacatacatatatatatatttgtctgtaagaattatgttttaaacagctgctgtagagtacctttttttaagtaaatcttacagtggagtatattttttaaagcacaaaattggtgccaagactgggtgagaaatgtacattacccccttattattttgacggtttttttttttcggggcaggggaccttacctgtaagacttttaaagattttcctccctcctgtttcaggtgggtcacattctgatgaatgtttcccttgtacagatcccagcttatggccttgacccagccgtcctcacagatgccgggtgaccctctagctctctctgcatctcccaccccccgacaccctgggaccctcaacctctgggaagaaggaagggagggaggaaggacgggaggagggaaggaaggacggaaggacggaaggaaggcaggaaggacatgacatgacttctctgctggctctcctaatcagtgcatctatggacaggtatgtattgcagcagcgacagcacacctgcctcatcctggggctcctctagagtcta

SEQ ID NO: 449373 - DNA, 2155 bp, Homo sapiens
ttttttttctcctccgcacagaagtcgcgctcgggcagcctgcgcgctcgcagcaggaaccaggctccaggcgccggcgccggggccgcggggaggaggcgacttcgctccctgcggcgggcgcggcccgggcgcccgagcctcctcggccttggagagcagcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcggaaggcagcatccctgcatgccgtccatatacaacccctctttgaaaaaagacacagagaataaactcctacgaaagccctacattgagctccaatctgctcggggtgggacgggtgcttcccacacctctgggagaaggctgcagccacctgggggtcccagggtggtgggggtggcaggtggtaccacagctctgagagcagataccaggggtactaagaggtgcttagacaagggctggtgcccggcccagggtgcccagcggggccatgccatggcagataaagctcaggacgtcaaaaactcaccatggaccccaaggcagaaaccaagaactgtctgcaggcaaataagcacccagcacccatcctggctgccggtgccccgtaccctgtatttattcttttaacaataacaaaagccatttatttattccatctagaaaggaaaccctgtttcagtcccctctctctggctgttctgttactttccttccacctgtgccctccctgggatatgtatgcctcgcccgccctccctgggcacatgtgcacacgtgcccaggcacaagtatgtctctgggtcccttgccctgcagtttccagggggctctgctccaagttccctagcgggcccctcagggagaaatagcgaccccacccttctttcctaccagcccagagccttgtggcttgtacagttttgaaactcccgttctattttatgatggttgataatagtcagtaacctaataaaggaacgtttgttaaaatatcaaaaaaattgaa

SEQ ID NO: 449374 - DNA, 1347 bp, Homo sapiens
ttttttttctcctccgcacagaagtcgcgctcgggcagcctgcgcgctcgcagcaggaaccaggctccaggcgccggcgccggggccgcggggaggaggcgacttcgctccctgcggcgggcgcggcccgggcgcccgagcctcctcggccttggagagcagcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcggaaggcagcatccctgcatgccgtccatatacaacccctctttgaaaaaagacacagagaataaactcctacgaaagcccta

SEQ ID NO: 449375 - DNA, 3125 bp, Homo sapiens
ttttttttctcctccgcacagaagtcgcgctcgggcagcctgcgcgctcgcagcaggaaccaggctccaggcgccggcgccggggccgcggggaggaggcgacttcgctccctgcggcgggcgcggcccgggcgcccgagcctcctcggccttggagagcagcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcggaaggcagcatccctgcatgccgtccatatacaacccctctttgaaaaaagacacagagaataaactcctacgaaagccctacattgagctccaatctgctcggggtgggacgggtgcttcccacacctctgggagaaggctgcagccacctgggggtcccagggtggtgggggtggcaggtggtaccacagctctgagagcagataccaggggtactaagaggtgcttagacaagggctggtgcccggcccagggtgcccagcggggccatgccatggcagataaagctcaggacgtcaaaaactcaccatggaccccaaggcagaaaccaagaactgtctgcaggcaaataagcacccagcacccatcctggctgccggtgccccgtaccctgtatttattcttttaacaataacaaaagccatttatttattccatctagaaaggaaaccctgtttcagtcccctctctctggctgttctgttactttccttccacctgtgccctccctgggatatgtatgcctcgcccgccctccctgggcacatgtgcacacgtgcccaggcacaagtatgtctctgggtcccttgccctgcagtttccagggggctctgctccaagttccctagcgggcccctcagggagaaatagcctcacgtgcaatctgggtgtcttcgggggcccgtctggaagggctgcagcaattcccctgtgtctccaggtaaccagctaactcttgggctcaggcacccttgcacagggttgcatttctttagtcttctgtgggtcttttgatgtgggtttgattttgcttttgcttttctagctgagatttcccaagtgcatcctcagaagctctgggtgtgccagaggacccccagaactaagaagggagggcgagtgggtctccattccccgagaagccaggggcagggtgggatggggaagaccaggagcagagtcgagcctcacagaagccagcgcgggtctctgctcagcaccccagccggggctctggacccagggtaacagccccagttcatcccaacccctctcagagcctcaagaggggtagctcggctgccggaagagaggggtgccctatccctggcaacccctccacgtagcgtaccccagcacctgccaccgcctttgccatttctttgagcttgaagttaactctcttagagtctaactttggttcatttctgcacaggtacaatagatgactttatttgtttaaaatgtttaatatatatacatacatatatatatatttgtctgtaagaattatgttttaaacagctgctgtagagtacctttttttaagtaaatcttacagtggagtatattttttaaagcacaaaattggtgccaagactgggtgagaaatgtacattacccccttattattttgacggtttttttttttcggggcaggggaccttacctgtaagacttttaaagattttcctccctcctgtttcaggtgggtcacattctgatgaatgtttcccttgtacagatcccagcttatggccttgacccagccgtcctcacagatgccgggtgaccctctagctctctctgcatctcccaccccccgacaccctgggaccctcgaccccacccttctttcctaccagcccagagccttgtggcttgtacagttttgaaactcccgttctattttatgatggttgataatagtcagtaacctaataaaggaacgtttgttaaaatatcaaaaaaattgaa

SEQ ID NO: 449376 - DNA, 2900 bp, Homo sapiens
ttttttttctcctccgcacagaagtcgcgctcgggcagcctgcgcgctcgcagcaggaaccaggctccaggcgccggcgccggggccgcggggaggaggcgacttcgctccctgcggcgggcgcggcccgggcgcccgagcctcctcggccttggagagcagcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcggaaggcagcatccctgcatgccgtccatatacaacccctctttgaaaaaagacacagataaagctcaggacgtcaaaaactcaccatggaccccaaggcagaaaccaagaactgtctgcaggcaaataagcacccagcacccatcctggctgccggtgccccgtaccctgtatttattcttttaacaataacaaaagccatttatttattccatctagaaaggaaaccctgtttcagtcccctctctctggctgttctgttactttccttccacctgtgccctccctgggatatgtatgcctcgcccgccctccctgggcacatgtgcacacgtgcccaggcacaagtatgtctctgggtcccttgccctgcagtttccagggggctctgctccaagttccctagcgggcccctcagggagaaatagcctcacgtgcaatctgggtgtcttcgggggcccgtctggaagggctgcagcaattcccctgtgtctccaggtaaccagctaactcttgggctcaggcacccttgcacagggttgcatttctttagtcttctgtgggtcttttgatgtgggtttgattttgcttttgcttttctagctgagatttcccaagtgcatcctcagaagctctgggtgtgccagaggacccccagaactaagaagggagggcgagtgggtctccattccccgagaagccaggggcagggtgggatggggaagaccaggagcagagtcgagcctcacagaagccagcgcgggtctctgctcagcaccccagccggggctctggacccagggtaacagccccagttcatcccaacccctctcagagcctcaagaggggtagctcggctgccggaagagaggggtgccctatccctggcaacccctccacgtagcgtaccccagcacctgccaccgcctttgccatttctttgagcttgaagttaactctcttagagtctaactttggttcatttctgcacaggtacaatagatgactttatttgtttaaaatgtttaatatatatacatacatatatatatatttgtctgtaagaattatgttttaaacagctgctgtagagtacctttttttaagtaaatcttacagtggagtatattttttaaagcacaaaattggtgccaagactgggtgagaaatgtacattacccccttattattttgacggtttttttttttcggggcaggggaccttacctgtaagacttttaaagattttcctccctcctgtttcaggtgggtcacattctgatgaatgtttcccttgtacagatcccagcttatggccttgacccagccgtcctcacagatgccgggtgaccctctagctctctctgcatctcccaccccccgacaccctgggaccctcgaccccacccttctttcctaccagcccagagccttgtggcttgtacagttttgaaactcccgttctattttatgatggttgataatagtcagtaacctaataaaggaacgtttgttaaaatatcaaaaaaattgaa

SEQ ID NO: 449377 - DNA, 1459 bp, Homo sapiens
aagcccctctcgaaagaagggggcagaaaccaagaactgtctgcaggcaaataagcacccagcacccatcctggctgccggtgccccgtaccctgtatttattcttttaacaataacaaaagccatttatttattccatctagaaaggaaaccctgtttcagtcccctctctctggctgttctgttactttccttccacctgtgccctccctgggatatgtatgcctcgcccgccctccctgggcacatgtgcacacgtgcccaggcacaagtatgtctctgggtcccttgccctgcagtttccagggggctctgctccaagttccctagcgggcccctcagggagaaatagcctcacgtgcaatctgggtgtcttcgggggcccgtctggaagggctgcagcaattcccctgtgtctccaggtaaccagctaactcttgggctcaggcacccttgcacagggttgcatttctttagtcttctgtgggtcttttgatgtgggtttgattttgcttttgcttttctagctgagatttcccaagtgcatcctcagaagctctgggtgtgccagaggacccccagaactaagaagggagggcgagtgggtctccattccccgagaagccaggggcagggtgggatggggaagaccaggagcagagtcgagcctcacagaagccagcgcgggtctctgctcagcaccccagccggggctctggacccagggtaacagccccagttcatcccaacccctctcagagcctcaagaggggtagctcggctgccggaagagaggggtgccctatccctggcaacccctccacgtagcgtaccccagcacctgccaccgcctttgccatttctttgagcttgaagttaactctcttagagtctaactttggttcatttctgcacaggtacaatagatgactttatttgtttaaaatgtttaatatatatacatacatatatatatatttgtctgtaagaattatgttttaaacagctgctgtagagtacctttttttaagtaaatcttacagtggagtatattttttaaagcacaaaattggtgccaagactgggtgagaaatgtacattacccccttattattttgacggtttttttttttcggggcaggggaccttacctgtaagacttttaaagattttcctccctcctgtttcaggtgggtcacattctgatgaatgtttcccttgtacagatcccagcttatggccttgacccagccgtcctcacagatgccgggtgaccctctagctctctctgcatctcccaccccccgacaccctgggaccctcgaccccacccttctttcctaccagcccagagccttgtggcttgtacagttttgaaactcccgttctattttatgatggttgataatagtcagtaacctaataaaggaacgtttgttaaaatatcaaaaaaattgaa

SEQ ID NO: 449378 - DNA, 2908 bp, Homo sapiens
ttttttttctcctccgcacagaagtcgcgctcgggcagcctgcgcgctcgcagcaggaaccaggctccaggcgccggcgccggggccgcggggaggaggcgacttcgctccctgcggcgggcgcggcccgggcgcccgagcctcctcggccttggagagcagcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcggaaggcagcatccctgcatgccgtccatatacaacccctctttgaaaaaagacacagagaataaactcctacgaaagccctacattgagctccaatctgctcggggtgggacgggtgcttcccacacctctgggagaaggctgcagccacctgggggtcccagggtggtgggggtggcaggtggtaccacagctctgagagcagataccaggggtactaagaggtgcttagacaagggctggtgcccggcccagggtgcccagcggggccatgccatggcagataaagctcaggacgtcaaaaactcaccatggaccccaaggcagaaaccaagaactgtctgcaggcaaataagcacccagcacccatcctggctgccggtgccccgtaccctgtatttattcttttaacaataacaaaagccatttatttattccatctagaaaggaaaccctgtttcagtcccctctctctggctgttctgttactttccttccacctgtgccctccctgggatatgtatgcctcgcccgccctccctgggcacatgtgcacacgtgcccaggcacaagtatgtctctgggtcccttgccctgcagtttccagggggctctgctccaagttccctagcgggcccctcagggagaaatagcctcacgtgcaatctgggtgtcttcgggggcccgtctggaagggctgcagcaattcccctgtgtctccaggtaaccagctaactcttgggctcaggcacccttgcacagggttgcatttctttagtcttctgtgggtcttttgatgtgggtttgattttgcttttgcttttctagctgagatttcccaagtgcatcctcagaagctctgggtgtgccagaggacccccagaactaagaagggagggcgagtgggtctccattccccgagaagccaggggcagggtgggatggggaagaccaggagcagagtcgagcctcacagaagccagcgcgggtctctgctcagcaccccagccggggctctggacccagggtaacagccccagttcatcccaacccctctcagagcctcaagaggggtagctcggctgccggaagagaggggtgccctatccctggcaacccctccacgtagcgtaccccagcacctgccaccgcctttgccatttctttgagcttgaagttaactctcttagagtctaactttggttcatttctgcacaggtacaatagatgactttatttgtttaaaatgtttaatatatatacatacatatatatatatttgtctgtaagaattatgttttaaacagctgctgtagagtacctttttttaagtaaatcttacagtggagtatattttttaaagcacaaaattggtgccaagactgggtgagaaatgtacattaccccgaccccacccttctttcctaccagcccagagccttgtggcttgtacagttttgaaactcccgttctattttatgatggttgataatagtcagtaacctaataaaggaacgtttgttaaaatatcaaaaaaattgaa

SEQ ID NO: 449379 - DNA, 1448 bp, Homo sapiens
ttttttttctcctccgcacagaagtcgcgctcgggcagcctgcgcgctcgcagcaggaaccaggctccaggcgccggcgccggggccgcggggaggaggcgacttcgctccctgcggcgggcgcggcccgggcgcccgagcctcctcggccttggagagcagcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcggaaggcagcatccctgcatgccgtccatatacaacccctctttgaaaaaagacacagagaataaactcctacgaaagcccta

SEQ ID NO: 449380 - DNA, 454 bp, Homo sapiens
  misc_feature (63)..(63): n is a, c, g, or t
ccacatcccctctgcagacttttttcacttggctgatgtttctcctccttcaagttcaccttngacatcatttcctctgtgaaaacttttttttgacatgcaggagagtttatcctaatagattgtgaggtccttgaggacaaagtcaatatctaataaccatctttttatttcacacagcacagcacacaacttatcttataatgttggtcagtataagcagttgaatggatgggtgtatgcatggatggatagatgaatgaatgaatggatggatggatggatggatgaatgaatgaaacatatactactgattattttattccagagttctcaaaatatttgttgctgatattttgagtgctgactgtaattactttgattagataaacaactggaaataatgctgctgaaaaagttctaataaatgtgtattttatcagatgttttctgt

SEQ ID NO: 449381 - DNA, 4359 bp, Homo sapiens
gcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccagctcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgatgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgttctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacggagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcgggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcagtaagtttcctgaccacagtttactggccataaactcattctgaacagtagcctggtgtgcatcaccattgtcacagtcactgtgtagctttgtaggaaggatttcagttcctctatgagttcacatctgtgtagggggtaaccataattgaattcaaatacatcaccattggataattttctgattaaatcctttgtacttggttatgt

SEQ ID NO: 449382 - DNA, 345 bp, Homo sapiens
ctcctggtcttctgatccacatctgtgacttgggtttttctcatgacttgtatgcttgtggtagttaagaactatctctgtagccagtactggagatagcctgaatggtaagccttgtgtattcctgtgacacactgaaaaatcgtttgaagcctacccagtggtgctgaacctttgtttgcctttcctctgagtgtaaggactgttcaagaaatacagcagctggcagtagccacagtgaagaaagggttcttttgtaggagccatggccttggaactgctcacctccccttgtctttctttccagggtgaaattcacagagtgaagacagatggcaccaacag

SEQ ID NO: 449383 - DNA, 15638 bp, Homo sapiens
  misc_feature (8693)..(8693): n is a, c, g, or t
gcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccagctcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgatgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgttctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacggagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcgggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgcgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccaggtgaaattcacagagtgaagacagatggcaccaacaggacagtatttgcttctatatctatggtggggccttctatgaacctggccttagattggatttcaagaaacctttattctaccaatcctagaactcagtcaatcgaggttttgacactccacggagatatcagatacagaaaaacattgattgccaatgatgggacagctcttggagttggctttccaattggcataactgttgatcctgctcgtgggaagctgtactggtcagaccaaggaactgacagtggggttcctgccaagatcgccagtgctaacatggatggcacatctgtgaaaactctctttactgggaacctcgaacacctggagtgtgtcactcttgacatcgaagagcagaaactctactgggcagtcactggaagaggagtgattgaaagaggaaacgtggatggaacagatcggatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcaatgccgccgaatcctcaaatggctgtagcaacaacatgaatgcctgtcagcagatttgcctgcctgtaccaggaggattgttttcctgcgcctgtgccactggatttaaactcaatcctgataatcggtcctgctctccatataactctttcattgttgtttcaatgctgtctgcaatcagaggctttagcttggaattgtcagatcattcagaaaccatggtgccggtggcaggccaaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtacctgtactgggctgactgggatacacatgccaaaatcgagagagccacattgggaggaaacttccgggtacccattgtgaacagcagtctggtcatgcccagtgggctgactctggactatgaagaggaccttctctactgggtggatgctagtctgcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaaatttgctctcccagcccaggggaatcaacactgttgtgaagaaccagaaacaacagtgtaacaatccttgtgaacagtttaatgggggctgcagccatatctgtgcaccaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtgcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccctgatcgcacttgccagtctggatacacaaaatgtcataattcaaatatttgtattcctcgcgtttatttgtgtgacggagacaatgactgtggagataacagtgatgaaaaccctacttattgcaccactcacacntgcagcagcagtgagttccaatgcgcatctgggcgctgtattcctcaacattggtattgtgatcaagaaacagattgttttgatgcctctgatgaacctgcctcttgtggtcactctgagcgaacatgcctagctgatgagttcaagtgtgatggtgggaggtgcatcccaagcgaatggatctgtgacggtgataatgactgtggggatatgagtgacgaggataaaaggcaccagtgtcagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgcaaccacctagatgactgtttggacaacagcgatgagaaaggctgtggcattaatgaatgccatgacccttcaatcagtggctgcgatcacaactgcacagacaccttaaccagtttctattgttcctgtcgtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcaaccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattgtgagcaatccctgtggtaccaacaatggtggctgttctcatctctgcctcatcaagccaggaggaaaagggttcacttgcgagtgtccagatgacttccgcacccttcaactgagtggcagcacctactgcatgcccatgtgctccagcacccagttcctgtgcgctaacaatgaaaagtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtgagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcatgagctctgcccatctctgtgacaacttcacagaattcagctgcaaaacaaattaccgctgcatcccaaagtgggccgtgtgcaatggtgtagatgactgcagggacaacagtgatgagcaaggctgtgaggagaggacatgccatcctgtgggggatttccgctgtaaaaatcaccactgcatccctcttcgttggcagtgtgatgggcaaaatgactgtggagataactcagatgaggaaaactgtgctccccgggagtgcacagagagcgagtttcgatgtgtcaatcagcagtgcattccctcgcgatggatctgtgaccattacaacgactgtggggacaactcagatgaacgggactgtgagatgaggacctgccatcctgaatattttcagtgtacaagtggacattgtgtacacagtgaactgaaatgcgatggatccgctgactgtttggatgcgtctgatgaagctgattgtcccacacgctttcctgatggtgcatactgccaggctactatgttcgaatgcaaaaaccatgtttgtatcccgccatattggaaatgtgatggcgatgatgactgtggcgatggttcagatgaagaacttcacctgtgcttggatgttccctgtaattcaccaaaccgtttccggtgtgacaacaatcgctgcatttatagtcatgaggtgtgcaatggtgtggatgactgtggagatggaactgatgagacagaggagcactgtagaaaaccgacccctaaaccttgtacagaatatgaatataagtgtggcaatgggcattgcattccacatgacaatgtgtgtgatgatgccgatgactgtggtgactggtccgatgaactgggttgcaataaaggaaaagaaagaacatgtgctgaaaatatatgcgagcaaaattgtacccaattaaatgaaggaggatttatctgctcctgtacagctgggttcgaaaccaatgtttttgacagaacctcctgtctagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtagctctcctttgttgctactgcctgacaatgtccgaattcgaaaatataatctctcatctgagaggttctcagagtatcttcaagatgaggaatatatccaagctgttgattatgattgggatcccaaggacataggcctcagtgttgtgtattacactgtgcgaggggagggctctaggtttggtgctatcaaacgtgcctacatccccaactttgaatccggccgcaataatcttgtgcaggaagttgacctgaaactgaaatacgtaatgcagccagatggaatagcagtggactgggttggaaggcatatttactggtcagatgtcaagaataaacgcattgaggtggctaaacttgatggaaggtacagaaagtggctgatttccactgacctggaccaaccagctgctattgctgtgaatcccaaactagggcttatgttctggactgactggggaaaggaacctaaaatcgagtctgcctggatgaatggagaggaccgcaacatcctggttttcgaggaccttggttggccaactggcctttctatcgattatttgaacaatgaccgaatctactggagtgacttcaaggaggacgttattgaaaccataaaatatgatgggactgataggagagtcattgcaaaggaagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcagtgcccaacctttgcaaacagatctgcagccacctctgccttctgagacctggaggatacagctgtgcctgtccccaaggctccagctttatagaggggagcaccactgagtgtgatgcagccatcgaactgcctatcaacctgccccccccatgcaggtgcatgcacggaggaaattgctattttgatgagactgacctccccaaatgcaagtgtcctagcggctacaccggaaaatattgtgaaatggcgttttcaaaaggcatctctccaggaacaaccgcagtagctgtgctgttgacaatcctcttgatcgtcgtaattggagctctggcaattgcaggattcttccactatagaaggaccggctcccttttgcctgctctgcccaagctgccaagcttaagcagtctcgtcaagccctctgaaaatgggaatggggtgaccttcagatcaggggcagatcttaacatggatattggagtgtctggttttggacctgagactgctattgacaggtcaatggcaatgagtgaagactttgtcatggaaatggggaagcagcccataatatttgaaaacccaatgtactcagccagagacagtgctgtcaaagtggttcagccaatccaggtgactgtatctgaaaatgtggataataagaattatggaagtcccataaacccttctgagatagttccagagacaaacccaacttcaccagctgctgatggaactcaggtgacaaaatggaatctcttcaaacgaaaatctaaacaaactaccaactttgaaaatccaatctatgcacagatggagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatagctataccagctatttagggaataattagaaacacacttttgcacatatattttttacaaacagatgaaaaaagttaacattcagtactttatgaaaaaaatatatttttccctgtttgcctatagttggaggtatcctgtgtgtctttttttacttatgccgtctcatatttttacaaataattatcacaatgtactatatgtatatctttgcactgaagttgtctgaaggtaatactataaatatattgtatatttgtaaattttggaaagattatcctgttactgaatttgctaataaagatgtctgctgatttggttggtgatcattatagtaaatgatccaacaagaaaaggaattgactggggacctttagccgtgtctaaagaagaggcaccactcatatttcctataaaattatctaggaaaggaatccaggccccgctcttgggtccatttttacacattagcacttaattaatgttcaatattacatgtcaatttgattaatggctatgttgataggggccactatgtgttgtatagacatctggacttgactgtagactcctcagataatacagaaggtaggaaaagcaattcagtttggcccttctgtgtgttggcattgtctaaccagaactctctgtttcatgtgtgttctctcactagctgccaagacaacatttttatttgtgatgtctatgaggaaatcccatatcattaagtgccagtgtcctgcattgagtttgtggttaattaaatgagctcttctgctgatggaccctggagcaatttctcccctcacctgacattcaaggtggtcacctgccctagtagttggagctcagtagctgaatttctgaaaccaaatctgtgtcttcataaaataaggtgcaaaaaaaaaaaaataccagttaagtaaagcctcaactgggtttttgtttctatgaaaatatcattataatcactatttatttcctaagttgaacctgaatagaaagggaaaccattcttattaagctttttattaggccctgtggctaaatgtgtacatttatattagaatgtactgtacagtccagatcttttctttaattcttattggtttttttttttttttttttttttagagatggagtcttgctatattgccaaggctgatcttgaagtcctgggctcaagtgatcctcccacctcagcctcctgagtggttggggttacgggcgtgagccactgtgcctggcttccagctctcctcttaaatagtgggtatagtctgcacaacaggaaccatggcaggaatatacactttcccatagcaaatagcatacctgactctctgtgctaatattgcacatttgttaaacaatgaatgaatggatggatggatggatggatgaatgaatgaaacatatactactgattattttattccagagttctcaaaatatttgttgctgatattttgagtgctgactgtaattactttgattagataaacaactggaaataatgctgctgaaaaagttctaataaatgtgtattttatcagatgttttctgt

SEQ ID NO: 449384 - DNA, 5677 bp, Homo sapiens
gcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccagctcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgatgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgttctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacggagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcgggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgcgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagaggtatagtatgctccttatgtgagctctgaagatggagctggtcatagtttgtgccaagcagtggaaactctaaaaccaattgcgactgaacatgtgctgtgtcctttgattcctcaggtgtctgcagaatgatgtgtgttgtatggggtgatgtcactgtgtgccttggttgtaatacagtttctgtatatggaactaatgttatctgtgcatgtaattgaacaatctgtaacctcatattttctctcacctgggtacagttagacttctctgacaagccatgataatgggaagttccaaattcttcacctaagaagtaaacattctcaacgtttgtgtacagctt

SEQ ID NO: 449385 - DNA, 290 bp, Homo sapiens
tatatcagaagcccctgtggtttggactcagactcaggaggtgactcaagcctcaagctcagaagccctctgtcaccatctgttgactcagaagcatgcccaccatcccatgcagtgcttttccaggcactgtcctgtagcagacggagttcaggctttggaagtagacagacctgggttcaaatcacagctccgcttcttccgcctgaagctccataacctaggataagtcgctaagcctccccaagtctcagatttcttacctctaaggtgaaggatggattccactt

SEQ ID NO: 449386 - DNA, 2776 bp, Homo sapiens
ctgagctgcctggcgccgtcttgatactttcagaaagaatgcattccctgtaaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccatacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacagaaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaaggaaaaagttgtaggcgaatcatttgttcaaagctgttggcctctgcaaaggaaataccagttctgggcaatcagtgttaccgttcaccagttgccattgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggcctaa

SEQ ID NO: 449387 - DNA, 3185 bp, Homo sapiens
ctgagctgcctggcgccgtcttgatactttcagaaagaatgcattccctgtaaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccatacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacagaaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaaggaaaaagttgtaggcgaatcatttgttcaaagctgttggcctctgcaaaggaaataccagttctgggcaatcagtgttaccgttcaccagttgccattgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggcctaaggtggttgtgctcggagggtttcttgtttcttttccattttgtttttggatgatatttattaaatagcttctaagagtccggcggcatctgtcttgtccctattcctgcagcctgtgctgagggtagcagtgtatgagctaccagcgtgcatgtcagcgaccctggcccgacaggccacgtcctgcaatcggcccggctgcctcttcgccctgtcgtgttctgtgttagtgatcactgcctttaatacagtctgttggaataatattataagcataataataaagtgaaaatattttaaaactacaaaatgacatcgtatccacgtggtggccgagctcttctagaatctggtagctctagctaatttcagagaaaggagttaaaagaaacaacttaacaaccagacat

SEQ ID NO: 449388 - DNA, 1311 bp, Homo sapiens
  misc_feature (34)..(34): n is a, c, g, or t
  misc_feature (65)..(66): n is a, c, g, or t
  misc_feature (79)..(79): n is a, c, g, or t
  misc_feature (89)..(89): n is a, c, g, or t
  misc_feature (97)..(97): n is a, c, g, or t
  misc_feature (99)..(99): n is a, c, g, or t
  misc_feature (138)..(138): n is a, c, g, or t
  misc_feature (145)..(145): n is a, c, g, or t
  misc_feature (157)..(157): n is a, c, g, or t
  misc_feature (162)..(162): n is a, c, g, or t
  misc_feature (198)..(198): n is a, c, g, or t
  misc_feature (214)..(214): n is a, c, g, or t
  misc_feature (216)..(217): n is a, c, g, or t
  misc_feature (235)..(235): n is a, c, g, or t
  misc_feature (248)..(248): n is a, c, g, or t
  misc_feature (336)..(336): n is a, c, g, or t
  misc_feature (341)..(341): n is a, c, g, or t
  misc_feature (348)..(348): n is a, c, g, or t
  misc_feature (357)..(357): n is a, c, g, or t
  misc_feature (371)..(371): n is a, c, g, or t
  misc_feature (387)..(387): n is a, c, g, or t
  misc_feature (417)..(417): n is a, c, g, or t
tattttgaagcaggagcgcgccttaagctattanaacaaaaaagaaaagagcaatgcgcagaggnncacagaaagcgcncaaaaataanaatgctananaaaaaatgcgcaaaaaaaaattaaaaaaaaagaaaattngcattanagctgcaagctnataantatagctttgcgcgcgcaaataaaagacatgctgcntttttaaagcgcgctngnnccgcgcgctgctgcgcantaggcagcaattntgcgctgcgcgcttaatgcgcagcaatgctgctgcgcgcttgcatgcgcagctgcgcatgcgcagcatttgctttagcgcagctgcgncagcngcgctanttgcagcgnctgcgcatgcgcangcgctttgcgcttttnagcgcgcgcgcgcgcgcgctgcgcagcatnttgcgcgcggcgcattttttatagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaaggaaaaagttgtaggcgaatcatttgttcaaagctgttggcctctgcaaaggaaataccagttctgggcaatcagtgttaccgttcaccagttgccattgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggcctaa

SEQ ID NO: 449389 - DNA, 2950 bp, Homo sapiens
ctgagctgcctggcgccgtcttgatactttcagaaagaatgcattccctgtaaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccatacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacagaaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaaggaaaaagttgtaggcgaatcatttgttcaaagctgttggcctctgcaaaggaaataccagttctgggcaatcagtgttaccgttcaccagttgccattgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggcctaaaaaaaaaaaacaaacaaaaaaacaaaaaaacaaaaaaaagaacaaaagaggggggcgcccccccactaaaaagttcccccgagaggggcgcccaatgtttgcgcgggatcccacaggctttttggtacaaagagggggtccccaaattaggggggccgtaatttaaacacaagg

SEQ ID NO: 449390 - DNA, 1083 bp, Homo sapiens
aagttaagtaatatgcccgaggtacgttttcaatggaagaggctgactgagggtcacccaacttatatctcgaaatttcacaatttctacaagttctgtcctgggaggcaagagtaggtgaaacgagcacactctacgccaggcaaacaaacctcaacgcttagcctcccggcacctcctagggccggaagcttctcagcccaaagccgctgctggctgcaacctccgtcccgcagtccaattagcagccgcgacccggcgcccgcccacgccgcgtcacgagtcagccaaagatggctgcgcccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacagtttccgccaagctctctttcctccctcctatccgcgacataatccgacacgattt

SEQ ID NO: 449391 - DNA, 1066 bp, Homo sapiens
aagttaagtaatatgcccgaggtacgttttcaatggaagaggctgactgagggtcacccaacttatatctcgaaatttcacaatttctacaagttctgtcctgggaggcaagagtaggtgaaacgagcacactctacgccaggcaaacaaacctcaacgcttagcctcccggcacctcctagggccggaagcttctcagcccaaagccgctgctggctgcaacctccgtcccgcagtccaattagcagccgcgacccggcgcccgcccacgccgcgtcacgagtcagccaaagatggctgcgcccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacaacagatgcggccggactatttaaattaatatatttacttatcctaagcttgagacgattcg

SEQ ID NO: 449392 - DNA, 478 bp, Homo sapiens
atctatgctatagccttgaagcaaactggataaagaaacaaaagtttttaggattaatagacactgaagacctttactttaatattcagttttatcttaagacttctaggactaatatgtatcacagatgggtttgccatttgatgcaacaatcttttctattgaactatctcaatgttttcttacaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacaaaaacagtttatgtctaatgttatgtctaatgttatgcataaacatagacttgtaa

SEQ ID NO: 449393 - DNA, 585 bp, Homo sapiens
aagttaagtaatatgcccgaggtacgttttcaatggaagaggctgactgagggtcacccaacttatatctcgaaatttcacaatttctacaagttctgtcctgggaggcaagagtaggtgaaacgagcacactctacgccaggcaaacaaacctcaacgcttagcctcccggcacctcctagggccggaagcttctcagcccaaagccgctgctggctgcaacctccgtcccgcagtccaattagcagccgcgacccggcgcccgcccacgccgcgtcacgagtcagccaaagatggctgcgcccaggtaatttgagcaaaggccacagtgaactccggcgtggctgaggaaggaggaggcacccacaggctgctgggaggagagcataaggtactggtattccgggggagggggtgaagtaaatgtcccggtgtcaggagaagcacgacgcggtgacacgctagctaccagcagcgctgcgcgtaaatgagagcaagtagaagtgtagttagctcttcctgctgtcttttcactttgcactctagaaggaaagaccttatatttaaattaactcagtagaaagg

SEQ ID NO: 449394 - DNA, 1297 bp, Homo sapiens
aagttaagtaatatgcccgaggtacgttttcaatggaagaggctgactgagggtcacccaacttatatctcgaaatttcacaatttctacaagttctgtcctgggaggcaagagtaggtgaaacgagcacactctacgccaggcaaacaaacctcaacgcttagcctcccggcacctcctagggccggaagcttctcagcccaaagccgctgctggctgcaacctccgtcccgcagtccaattagcagccgcgacccggcgcccgcccacgccgcgtcacgagtcagccaaagatggctgcgcccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacaaaaaaaaaaaaaaaaaaaatttgggggccggccgggggcctagagaaaaaagcttctaaaacaccattccgcttggggcccgggcccaaataggtgaatgtacaacttgggcacacacgcggcgcaagggaaataccggccaagaacaagggctgggttccccaccaataaaaaagcggcgggcacccgcgggtccggaacaaccacaggggtccggggcaaacggtctcccacaggtgccacaacgttacgcgcgggcgcagagggtgg

SEQ ID NO: 449395 - DNA, 762 bp, Homo sapiens
  misc_feature (70)..(70): n is a, c, g, or t
aggaaccccctgtccaggcagacccgcgtgcttaggaatgagagccactcccagtggaagagaccataangctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacaaaaacagtttatgtctaatgttatgtctaatgttatgcataaacatagacttgtaa

SEQ ID NO: 449396 - DNA, 1020 bp, Homo sapiens
aagttaagtaatatgcccgaggtacgttttcaatggaagaggctgactgagggtcacccaacttatatctcgaaatttcacaatttctacaagttctgtcctgggaggcaagagtaggtgaaacgagcacactctacgccaggcaaacaaacctcaacgcttagcctcccggcacctcctagggccggaagcttctcagcccaaagccgctgctggctgcaacctccgtcccgcagtccaattagcagccgcgacccggcgcccgcccacgccgcgtcacgagtcagccaaagatggctgcgcccaggtaatttgagcaaaggccacagtgaactccggcgtggctgaggaaggaggaggcacccacaggctgctgggaggagagcataagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacaaaaacagtttatgtctaatgttatgtctaatgttatgcataaacatagacttgtaa

SEQ ID NO: 449397 - DNA, 1061 bp, Homo sapiens
aagttaagtaatatgcccgaggtacgttttcaatggaagaggctgactgagggtcacccaacttatatctcgaaatttcacaatttctacaagttctgtcctgggaggcaagagtaggtgaaacgagcacactctacgccaggcaaacaaacctcaacgcttagcctcccggcacctcctagggccggaagcttctcagcccaaagccgctgctggctgcaacctccgtcccgcagtccaattagcagccgcgacccggcgcccgcccacgccgcgtcacgagtcagccaaagatggctgcgcccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacaaaaacagtttatgtctaatgttatgtctaatgttatgcataaacatagacttgtaa

SEQ ID NO: 449398 - DNA, 590 bp, Homo sapiens
caattattcctagctattttaagttactcatagatgtaattataccttttaacaggctttgtacaattacatttgatatattacctgaaaaatacctgtgatacacaaaagaggatcttacattctttaaatcatgtttgcttgactatcatgaccttcatttctatgactaatttatttcctaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacaaaaacagtttatgtctaatgttatgtctaatgttatgcataaacatagacttgtaa

SEQ ID NO: 449399 - DNA, 621 bp, Homo sapiens
taagattttggttctataagggatagatgtcgtatccagttagtgtattcccaaagtcctataacacatgtcaagatcgggaaagctcacacacacaataatgccaaagaaaagttctttcttctcaccctttcaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtaaattctacttcactatcaccaaagagtttgccttagtatatgttatttgcagctttagtccatacttattaatatcaagtagctgtatgctgtaatgcagttaagattaaatcttgctagcctatataatgtggcaaataattcatattagtatggtctaccaaccaagatgcacatacacagcagttctaaatactttttctttaattgagatggagttttgctcttgttgcccaggttggagtgccctggcgcaatcttggctcactgcaacctccaccttctggg

SEQ ID NO: 449400 - DNA, 990 bp, Homo sapiens
aagttaagtaatatgcccgaggtacgttttcaatggaagaggctgactgagggtcacccaacttatatctcgaaatttcacaatttctacaagttctgtcctgggaggcaagagtaggtgaaacgagcacactctacgccaggcaaacaaacctcaacgcttagcctcccggcacctcctagggccggaagcttctcagcccaaagccgctgctggctgcaacctccgtcccgcagtccaattagcagccgcgacccggcgcccgcccacgccgcgtcacgagtcagccaaagatggctgcgcccaggtaatttgagcaaaggccacagtgaactccggcgtggctgaggaaggaggaggcacccacaggctgctgggaggagagcataaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacaaaaacagtttatgtctaatgttatgtctaatgttatgcataaacatagacttgtaa

SEQ ID NO: 449401 - DNA, 1083 bp, Homo sapiens
aagttaagtaatatgcccgaggtacgttttcaatggaagaggctgactgagggtcacccaacttatatctcgaaatttcacaatttctacaagttctgtcctgggaggcaagagtaggtgaaacgagcacactctacgccaggcaaacaaacctcaacgcttagcctcccggcacctcctagggccggaagcttctcagcccaaagccgctgctggctgcaacctccgtcccgcagtccaattagcagccgcgacccggcgcccgcccacgccgcgtcacgagtcagccaaagatggctgcgcccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacaaaaacagtttatgtctaatgttatgtctaatgttatgcataaacatagacttgtaa

SEQ ID NO: 449402 - DNA, 1088 bp, Homo sapiens
aagttaagtaatatgcccgaggtacgttttcaatggaagaggctgactgagggtcacccaacttatatctcgaaatttcacaatttctacaagttctgtcctgggaggcaagagtaggtgaaacgagcacactctacgccaggcaaacaaacctcaacgcttagcctcccggcacctcctagggccggaagcttctcagcccaaagccgctgctggctgcaacctccgtcccgcagtccaattagcagccgcgacccggcgcccgcccacgccgcgtcacgagtcagccaaagatggctgcgcccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacaacagatgcggccggactatttaaattaatatatttacttatcctaagcttgagacgattcg

SEQ ID NO: 449403 - DNA, 870 bp, Homo sapiens
gctaaaccacaagaagcctccagacagccctgagatcacctaaaaagctgctaccaagacagccacgaagatcctaccaaaatgaagcgcttcctcttcctcctactcaccatcagcctcctggttatggtacagatacaaactggactctcaggacaaactgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacaaaaacagtttatgtctaatgttatgtctaatgttatgcataaacatagacttgtaa

SEQ ID NO: 449404 - DNA, 589 bp, Homo sapiens
ttttttgaggggtttaccaaaggctctatggagttgacacgagcagagctttatttaatcataatagtaccagatacaaattactgctgtcttatttatatcccagggaccaaactagtgtttttcatatattggctcatttaattctcagaacaatcctacacactggttactgttgttctccctttcttccagaatgaagcaccccagttctctgctgagcacatgggcatctgcaataaagatttaatttcccagcttctcctgaagctcggtatggccacaacactaaattctgcccgaggagattaagcaaaatagtatgggacttccaagaaatgtttttaaagtcaggggcaggcctttcttcatgccttcttcctctttgctggctggaacgcaaagaccatggcaggaggccaagcagccatcctggaaggtgaaagcctcatactaaggacgtcagacagcgaaataagagcctgggtccttgaccctgtagacatctccctccccatcctggtctgtctgccttgactcctttcatatgagagaaataaacttttaacttgcgtaaaccagaaaaaaa

SEQ ID NO: 449405 - DNA, 599 bp, Homo sapiens
cagtctctcggaatccgcagcctaggtgtggcgccccgaccggactttcacttctggccagccctttccccacctgggcgcgggagcgggtgccagtctttaaacaacctctcgatgggtcccacgaagatgtttccagacccttggaatgccaagttcaagtttagctatgtctcgcggagaggccggtggaagaagcaacgagaatgaagcaccccagttctctgctgagcacatgggcatctgcaataaagatttaatttcccagcttctcctgaagctcggtatggccacaacactaaattctgcccgaggagattaagcaaaatagtatgggacttccaagaaatgtttttaaagtcaggggcaggcctttcttcatgccttcttcctctttgctggctggaacgcaaagaccatggcaggaggccaagcagccatcctggaaggtgaaagcctcatactaaggacgtcagacagcgaaataagagcctgggtccttgaccctgtagacatctccctccccatcctggtctgtctgccttgactcctttcatatgagagaaataaacttttaacttgcgtaaaccagaaaaaaa

SEQ ID NO: 449406 - DNA, 545 bp, Homo sapiens
tctatgagaaaacaagtggacatgttccaagactcccagcagtgggaggggcgtcagattagtgcacaaatgtctgctttaaccgtaatgtagaggaaatacaaggaacttgcattaaataaaagatgcccacaacactaccagacatacaaatgaagcaccccagttctctgctgagcacatgggcatctgcaataaagatttaatttcccagcttctcctgaagctcggtatggccacaacactaaattctgcccgaggagattaagcaaaatagtatgggacttccaagaaatgtttttaaagtcaggggcaggcctttcttcatgccttcttcctctttgctggctggaacgcaaagaccatggcaggaggccaagcagccatcctggaaggtgaaagcctcatactaaggacgtcagacagcgaaataagagcctgggtccttgaccctgtagacatctccctccccatcctggtctgtctgccttgactcctttcatatgagagaaataaacttttaacttgcgtaaaccagaaaaaaa

SEQ ID NO: 449407 - DNA, 1213 bp, Homo sapiens
ttttttgaggggtttaccaaaggctctatggagttgacacgagcagagctttatttaatcataatagtaccagatacaaattactgctgtcttatttatatcccagggaccaaactagtgtttttcatatattggctcatttaattctcagaacaatcctacacactggttactgttgttctccctttcttccagaatgaagcaccccagttctctgctgagcacatgggcatctgcaataaagatttaatttcccagcttctcctgaagctcggtatggccacaacactaaattctgcccgaggagattaagcaaaatagtatgggacttccaagaaatgtttttaaagtcaggggcaggcctttcttcatgccttcttcctctttgctggctggaacgcaaagaccatggcaggaggccaagcagccatcctggaaggtgaaagcctcatactaaggacgtcagacagcgaaataagagcctgggtccttgaccctgtagacatctccctccccatcctggtctgtctgccttgactcctttcatatgagagaaataaacttttaacttgcgtaaaccagaaaaaaattttacaattttttttcacacacagttgaatggaagccagactcatacactaatctcatctccacttttagagatgaggggaacagcttgcccacagtgacagccagtgtgagctgggtttctgttgcccaactcattggggttccaaccctcacctagactgccctatgaaatacctagaacttggtcaggagaaaagataagaggggaaaatgtcagcaaaagccaaagactaagggtagcaggggcagaagtgagagtgggaagtgaaaggtgatataatttccctattccactgagcaggaagaggctgcctttgcatccctctgtgtcgggagacagtctggggacagtcagcaggcaccttgctgcaggagagcccctgcaagagcagcctttgtggagctgtcccttccaccccagtaggagcttctcggacacagcatggcctctctccttcactctggtgtcttcactcagtactgggtcccagattttttttttttttttttttttttttgagatggagtctcactctgttgcccaggctggagtgcagtggctcgatctcggcccactgcaacctcctcctcctcctgggttcaagcggttctcctgcctcag

SEQ ID NO: 449408 - DNA, 426 bp, Homo sapiens
tctatgagaaaacaagtggacatgttccaagactcccagcagtgggaggggcgtcagattagtgcacaaatgtctgctttaaccgtaatgtagaggaaatacaaggaacttgcattaaataaaagatgcccacaacactaccagacatacatttgaggggaaaagtactgttctctgagggacaagagtgaaaccaggaggggaccagaacatagctctactttcccagggtagcattgaggggagaggttggccaatagtgggcgtgagagatcacagctggaggagatttaggggattaaggaggtgcggtgctgatataattactcaggtagccttgaagagttgcttcaaagaatggagagcctccctccccagcacctgtaggcattcatagtacccctctatttctgagtggtaggaaat

SEQ ID NO: 449409 - DNA, 617 bp, Homo sapiens
  misc_feature (590)..(590): n is a, c, g, or t
ttttttgaggggtttaccaaaggctctatggagttgacacgagcagagctttatttaatcataatagtaccagatacaaattactgctgtcttatttatatcccagggaccaaactagtgtttttcatatattggctcatttaattctcagaacaatcctacacactggttactgttgttctccctttcttccagaatgaagcaccccagttctctgctgagcacatgggcatctgcaataaagatttaatttcccagcttctcctgaagctcggtatggccacaacactaaattctgcccgaggagattaagcaaaatagtatgggacttccaagaaatgtttttaaagtcaggggcaggcctttcttcatgccttcttcctctttgctggctggaacgcaaagaccatggcaggaggccaagcagccatcctggaaggtgaaagcctcatactaaggacgtcagacagcgaaataagagcctgggtccttgaccctgtagacatctccctccccatcctggtctgtctgccttgactcctttcatatgagagaaataaacttttaacttgcgtaaaccagaaaaaaanaaacaaaatggcctccgtggaccttta

SEQ ID NO: 449410 - DNA, 3365 bp, Homo sapiens
aagtttccgaggagacttctcaggctgggctggacacacctttccaaggacccccaaactctgctccgtgcacgtcaaatgctcctttcccttgtgtccaaccccctacccctctccctaacacccctcttctcaacaagactcagcctctccccgaggtgggtgagcatccttgaggtttcccacccttaactgctgtgtccccggatggagccagagaaatgtggtgggggggccggggcagagtttcaacattgccccccagaaggaggagccagagatggggtctgtccaggaaaacaggatgccggagcccaggagtcgtcagcctagcagttgcctggcctccagatgcctcccaggggagcagatcctagcatgggccccaggggtgaggaagggcctggaaccagaattgtctggaaccctgatctgtaccaactttagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccggtcagtgtgatggttagggtaatggctgtggattagagggtcatgtgggccagggacatcgtggagggaggaacctctgtgaggtcagtgtgggggcaagggtagcgtggagctaggcatttctcccacaatgaccctcttctgccccatgtgaagcgcttgtcctggcatcaccctgggggcagtgatcttctccgctgtggaggcttctatacagccagtgaccctaacaaggaggatatcagagcagtggagttgatgctccaggctgggcattcagatgttgtcctgggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacaggtcagtgacttctatttttgactcgtgtttttttttccattgagatgtactctctgaagtttggtcttgatttgttttatgagaagtgaggtctgtgagtggggagggggagatttattctcattttcaggacgagacttttgccctacatctttcctagaataagaggtgagaatctcatgatttgtctctagatgtgggaggattgtgtgtaaccatcctttttcttgcttcctctgtccagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcatctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacaca

SEQ ID NO: 449411 - DNA, 2977 bp, Homo sapiens
aagtttccgaggagacttctcaggctgggctggacacacctttccaagggcctggaaccagaattgtctggaaccctgatctgtaccaactttagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccgcgcttgtcctggcatcaccctgggggcagtgatcttctccgctgtggaggcttctatacagccagtgaccctaacaaggaggatatcagagcagtggagttgatgctccaggctgggcattcagatgttgtcctgggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacaggtcagtgacttctatttttgactcgtgtttttttttccattgagatgtactctctgaagtttggtcttgatttgttttatgagaagtgaggtctgtgagtggggagggggagatttattctcattttcaggacgagacttttgccctacatctttcctagaataagaggtgagaatctcatgatttgtctctagatgtgggaggattgtgtgtaaccatcctttttcttgcttcctctgtccagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcatctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacaca

SEQ ID NO: 449412 - DNA, 3180 bp, Homo sapiens
aagtttccgaggagacttctcaggctgggctggacacacctttccaagggcctggaaccagaattgtctggaaccctgatctgtaccaactttagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccggtcagtgtgatggttagggtaatggctgtggattagagggtcatgtgggccagggacatcgtggagggaggaacctctgtgaggtcagtgtgggggcaagggtagcgtggagctaggcatttctcccacaatgaccctcttctgccccatgtgaagcgcttgtcctggcatcaccctgggggcagtgatcttctccgctgtggaggcttctatacagccagtgaccctaacaaggaggatatcagagcagtggagttgatgctccaggctgggcattcagatgttgtcctgggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaagagcgcggtgatcgtgatctcaatggcctcctctcttcactcgtccagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacaggtcagtgacttctatttttgactcgtgtttttttttccattgagatgtactctctgaagtttggtcttgatttgttttatgagaagtgaggtctgtgagtggggagggggagatttattctcattttcaggacgagacttttgccctacatctttcctagaataagaggtgagaatctcatgatttgtctctagatgtgggaggattgtgtgtaaccatcctttttcttgcttcctctgtccagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcatctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacaca

SEQ ID NO: 449413 - DNA, 2590 bp, Homo sapiens
tctggagctccccacagacactgatctcagtttcccccgagagtgtgagtgtaggcctctacaggcagctgcctctggggagttggggagcctaggggttaactctagacccccctcaaccctctggaccaaagtctgtccaggaaaacaggatgccggagcccaggagtcgtcagcctagcagttgcctggcctccagatgcctcccagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccgcgcttgtcctggcatcaccctgggggcagtgatcttctccgctgtggaggcttctatacagccagtgaccctaacaaggaggatatcagagcagtggagttgatgctccaggctgggcattcagatgttgtcctgggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaagagcgcggtgatcgtgatctcaatggcctcctctcttcactcgtccagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccagatgggcctctcatctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacaca

SEQ ID NO: 449414 - DNA, 2097 bp, Homo sapiens
attttgtataatccattggaggtgaatccggtcagaagggccccgaggttaggctgggacgaagatcctgatgagtgaggccttacaagcccctgctaccctcaattcagattttcattccctgacttccataagttccccctattccctgtgttccccattcccttatcatctcgtcatcctccctctttgggtcccaataatcccttccaacctcttaatttcttttcaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacaggtcagtgacttctatttttgactcgtgtttttttttccattgagatgtactctctgaagtttggtcttgatttgttttatgagaagtgaggtctgtgagtggggagggggagatttattctcattttcaggacgagacttttgccctacatctttcctagaataagaggtgagaatctcatgatttgtctctagatgtgggaggattgtgtgtaaccatcctttttcttgcttcctctgtccagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcatctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacaca

SEQ ID NO: 449415 - DNA, 2905 bp, Homo sapiens
tctggagctccccacagacactgatctcagtttcccccgagagtgtgagtgtaggcctctacaggcagctgcctctggggagttggggagcctaggggttaactctagacccccctcaaccctctggaccaaagtctgtccaggaaaacaggatgccggagcccaggagtcgtcagcctagcagttgcctggcctccagatgcctcccagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccgcgcttgtcctggcatcaccctgggggcagtgatcttctccgctgtggaggcttctatacagccagtgaccctaacaaggaggatatcagagcagtggagttgatgctccaggctgggcattcagatgttgtcctgggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacaggtcagtgacttctatttttgactcgtgtttttttttccattgagatgtactctctgaagtttggtcttgatttgttttatgagaagtgaggtctgtgagtggggagggggagatttattctcattttcaggacgagacttttgccctacatctttcctagaataagaggtgagaatctcatgatttgtctctagatgtgggaggattgtgtgtaaccatcctttttcttgcttcctctgtccagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcatctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttgtatctgcacttgcagcctcagctttcacacttcagcccttaagttcactaagaaggtctgagtttctgctgcagatagtggtgttaactggacaatggggagccaagagataccatcaaaatttaagtggaggggtcagacactgtgttagtgattaatgggcatcaacagacattgggctagtttttgttttttttttttttaactggggtcctagaaagaaggggacagaagaggctccaaaatacagttggg

SEQ ID NO: 449416 - DNA, 2768 bp, Homo sapiens
aagtttccgaggagacttctcaggctgggctggacacacctttccaaggacccccaaactctgctccgtgcacgtcaaatgctcctttcccttgtgtccaaccccctacccctctccctaacacccctcttctcaacaagactcagcctctccccgaggtgggtgagcatccttgaggtttcccacccttaactgctgtgtccccggatggagccagagaaatgtggtgggggggccggggcagagtttcaacattgccccccagaaggaggagccagagatggggtctgtccaggaaaacaggatgccggagcccaggagtcgtcagcctagcagttgcctggcctccagatgcctcccaggggagcagatcctagcatgggccccaggggtgaggaagggcctggaaccagaattgtctggaaccctgatctgtaccaactttagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacaggtcagtgacttctatttttgactcgtgtttttttttccattgagatgtactctctgaagtttggtcttgatttgttttatgagaagtgaggtctgtgagtggggagggggagatttattctcattttcaggacgagacttttgccctacatctttcctagaataagaggtgagaatctcatgatttgtctctagatgtgggaggattgtgtgtaaccatcctttttcttgcttcctctgtccagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcatctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacaca

SEQ ID NO: 449417 - DNA, 3092 bp, Homo sapiens
tctggagctccccacagacactgatctcagtttcccccgagagtgtgagtgtaggcctctacaggcagctgcctctggggagttggggagcctaggggttaactctagacccccctcaaccctctggaccaaagtctgtccaggaaaacaggatgccggagcccaggagtcgtcagcctagcagttgcctggcctccagatgcctcccagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccgcgcttgtcctggcatcaccctgggggcagtgatcttctccgctgtggaggcttctatacagccagtgaccctaacaaggaggatatcagagcagtggagttgatgctccaggctgggcattcagatgttgtcctgggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacaggtcagtgacttctatttttgactcgtgtttttttttccattgagatgtactctctgaagtttggtcttgatttgttttatgagaagtgaggtctgtgagtggggagggggagatttattctcattttcaggacgagacttttgccctacatctttcctagaataagaggtgagaatctcatgatttgtctctagatgtgggaggattgtgtgtaaccatcctttttcttgcttcctctgtccagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcatctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacaca

SEQ ID NO: 449418 - DNA, 3144 bp, Homo sapiens
aagtttccgaggagacttctcaggctgggctggacacacctttccaaggacccccaaactctgctccgtgcacgtcaaatgctcctttcccttgtgtccaaccccctacccctctccctaacacccctcttctcaacaagactcagcctctccccgaggtgggtgagcatccttgaggggagcagatcctagcatgggccccaggggtgaggaagggcctggaaccagaattgtctggaaccctgatctgtaccaactttagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccgcgcttgtcctggcatcaccctgggggcagtgatcttctccgctgtggaggcttctatacagccagtgaccctaacaaggaggatatcagagcagtggagttgatgctccaggctgggcattcagatgttgtcctgggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacaggtcagtgacttctatttttgactcgtgtttttttttccattgagatgtactctctgaagtttggtcttgatttgttttatgagaagtgaggtctgtgagtggggagggggagatttattctcattttcaggacgagacttttgccctacatctttcctagaataagaggtgagaatctcatgatttgtctctagatgtgggaggattgtgtgtaaccatcctttttcttgcttcctctgtccagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcatctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacaca

SEQ ID NO: 449419 - DNA, 1933 bp, Homo sapiens
ttctatgtgctttctcaatcctcctaccccaaacctttcccctctgtgcctctcacttctccttgccgtatttctcttctcattctcttctgccctagtttcttggacccctcttctttgtcccttcttcctctttatcacccagagcgcggtgatcgtgatctcaatggcctcctctcttcactcgtccagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcatctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacaca

SEQ ID NO: 449420 - DNA, 1661 bp, Homo sapiens
tactagacagtgagaagtgaaagacaaaatgtcttgagttccttagggaaagctactccactactcttctgcagctgtcacttatagtccctgggtgtccctaggaagacagaagacctagaatagcacagagggcaccctttttgtccttcctcaagtctgtttactcatcttcctgtctcgtgcacacataaggtgccctaaaatcaaccttaatcagtcccgaggcctagttgaagcctaatgaggagggtagaagagttctcatggggaggcttgtagttctagtcaccagtgcagtgagtgggtggcagcaggacaccctgtcctgatccagattggggaaactagggttatctggtctctctgttgccagttgattttcttttccttttagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcatctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacaca

SEQ ID NO: 449421 - DNA, 1846 bp, Homo sapiens
tctggagctccccacagacactgatctcagtttcccccgagagtgtgagtgtaggcctctacaggcagctgcctctggggagttggggagcctaggggttaactctagacccccctcaaccctctggaccaaagtctgtccaggaaaacaggatgccggagcccaggagtcgtcagcctagcagttgcctggcctccagatgcctcccagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccgcgcttgtcctggcatcaccctgggggcagtgatcttctccgctgtggaggcttctatacagccagtgaccctaacaaggaggatatcagagcagtggagttgatgctccaggctgggcattcagatgttgtcctgggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacaggtcagtgacttctatttttgactcgtgtttttttttccattgagatgtactctctgaagtttggtcttgatttgttttatgagaagtgaggtctgtgagtggggagggggagatttattctcattttcaggacgagacttttgccctacatctttcctagaataagaggtgagaatctcatgatttgtctctagatgtgggaggattgtgtgtaaccatcctttttcttgcttcctctgtccagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacaggtgaagtgtctaaacttc

SEQ ID NO: 449422 - DNA, 961 bp, Homo sapiens
  misc_feature (836)..(836): n is a, c, g, or t
  misc_feature (908)..(908): n is a, c, g, or t
  misc_feature (922)..(922): n is a, c, g, or t
  misc_feature (948)..(948): n is a, c, g, or t
tgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttcccttccaaaatctggtagaagccctgcttttaaaccgtttaaaacccaactnttgaagaaagagaagccttttaaagtgccccattccaaggccaaccgaaaacccccttggtggggtgcttgngaataaaccaatgnggtcttgaaggcccctgggaaaactntttaacccgaaat

SEQ ID NO: 449423 - DNA, 918 bp, Homo sapiens
tgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtgagtcatttgattaaaaacaaaaaaacctgtatcttgtttctctggggcatctggctgcccggggaatattatcagatgaactagttgtaggtatcaaaatggtagcctaggctttcctctgaacttgatgatttttctccataaaaatgactgttttggcttgtttggagcaatatatagtaaacacatcattaggcatcattaggcattatgcaaatcaattgtgtgaggaagaaaaataaataaaatattttcccatttcatgtaaggataaggaagtgatcatttaatcattaggcatgacaaagcaagcatgctagatttggccaaaatgtcattatatacaatgtcagttgcacttaaaataattatacaattagtacacctaaaatgacatgttggttccaaatagtaattatattctaactggtgctgacttgaagctgagtatcaacgcttaggcacagagaccgaatattttatg

SEQ ID NO: 449424 - DNA, 1006 bp, Homo sapiens
tgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagtcatttgcgaggagtcctttggtttccagttacctcccccacaggcgcacacgctggctgcttgcgttggcagcgacacacatccatgttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtgagtcatttgattaaaaacaaaaaaacctgtatcttgtttctctggggcatctggctgcccggggaatattatcagatgaactagttgtaggtatcaaaatggtagcctaggctttcctctgaacttgatgatttttctccataaaaatgactgttttggcttgtttggagcaatatatagtaaacacatcattaggcatcattaggcattatgcaaatcaattgtgtgaggaagaaaaataaataaaatattttcccatttcatgtaaggataaggaagtgatcatttaatcattaggcatgacaaagcaagcatgctagatttggccaaaatgtcattatatacaatgtcagttgcacttaaaataattatacaattagtacacctaaaatgacatgttggttccaaatagtaattatattctaactggtgctgacttgaagctgagtatcaacgcttaggcacagagaccgaatattttatg

SEQ ID NO: 449425 - DNA, 494 bp, Homo sapiens
agctttgcaggataggattctatgttctatgacaatgagataaccatttattcctgcatgggaaaaggtgaaagagtcatttgtctatgtgattggtgaatcagatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggtaccataagcagttgttggtttgtttggttttttttaagtgtgtttattgcaaaagattgcttagaaaagccagtgctttaggtttctgctggatgcatgctctgttctaga

SEQ ID NO: 449426 - DNA, 427 bp, Homo sapiens
tgaggatcccccacctctgaccgagccccgttaccttttatgctagtgggagaagggggagggggcgggagattttcccatctgaatattttatcagtggacacttggatttttaacaagtggaagctttgcaggataggattctatgttctatgacaatgagataaccatttattcctgcatgggaaaaggtgaaagagtcatttgtctatgtgattggtgaatcagatggagccaagaagttgcagaaaaatgttactgtacattccttcctgcccactcttctctttccccacagcacatctctgacttggagaaggaatttccatagacactgcccgagcaggatgatttctgggtttgtaggtaaagctcagaactcaggtattactgaccctattctcttttccacccttggctcactgtt

SEQ ID NO: 449427 - DNA, 3881 bp, Homo sapiens
tgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatctacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagtt

SEQ ID NO: 449428 - DNA, 3024 bp, Homo sapiens
gttccattcctgttgcccaggctagagtgcaatggcacagtcttggctcactgcaacctccgcctcctgggttcaagtgattctcctgcctcagcctcctgagtagctgggattagaggcgcccgccaccacgcctggctaatttttgtatttttagtagagacgggtttcaccatgttggccaggctggtctcgaactcctgacctcaggtgaaccacctgccttggcctcccaaagtgctgagattacaggtgtgagccacggtgcccggcctcgaccccaatatttagtgaaaagaatggtactattttatgttttgcaagttttcttaatgtctggcttaatacaagacagttggagtttcctgtttctgcagtttcacaactgcttcagtgagttgtgacatcacacatcatgtagtctttgcaaaactccactatacattcatgagaaaatgagactgagagggacaaatgacatcttagtattattatgagaatggcttaaagagaaggctcgttccccactgttgggactctcacttcagtcaaactaataactgaacattcatcatctatatggccttataacctttaatagctactattatgaatattatgtgtctattacgtaatcttgcagttggtagatacggcgaactgaatgttaagaggtgcttcgctggccagttcctaacgtaagttgaaaacttgtgatgctcacgggagcctcgtttttccctcctccccaccctgcctgcagggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatctacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagtt

SEQ ID NO: 449429 - DNA, 1978 bp, Homo sapiens
tgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgatgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagtt

SEQ ID NO: 449430 - DNA, 636 bp, Homo sapiens
tgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagtcatttgcgaggagtcctttggtttccagttacctcccccacaggcgcacacgctggctgcttgcgttggcagcgacacacatccatggtacggctggttttcactcggattgattatgggaagggctatggattagagctcctgtaaagcaccaggaggaatcccttgatttttcagaacagctgatttccaccaggaaagagatttactgaaatgtagttaaatagcgtgagtgctttaaagaaaccagaaaccacaagctgtaatgtttggaatgaaaattggtttcatctcatctgttctagaaatcctaaattttaaaatgctaaaaagtcagcgatagtttcctcggaagattccagcatgtgtgtcacaaagaaaaacactacttcatacttctacttgtgataaacgaagctgaattgtgatttcagatgatttatagatgtgcccagagcactttgcttatttcatggaaaa

SEQ ID NO: 449431 - DNA, 3935 bp, Homo sapiens
tgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatctacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagtt

SEQ ID NO: 449432 - DNA, 770 bp, Homo sapiens
tgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaatggcgggttgcctttttttggtggtaccaggttcctgtgagcaagtgccggttttccagttgtcct

SEQ ID NO: 449433 - DNA, 3881 bp, Homo sapiens
tgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatctacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcatcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagtt

SEQ ID NO: 449434 - DNA, 800 bp, Homo sapiens
tgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacagataacatctggttggacagcctattagctattgatgcaagaatgcttgttctcagaaccaccaggacttgagcgggagccttcttggaagcctcatcaagagcacatctctgacttggagaaggaatttccatagacactgcccgagcaggatgatttctgggtttgtaggtaaagctcagaactcaggtattactgaccctattctcttttccacccttggctcactgtt

SEQ ID NO: 449435 - DNA, 3201 bp, Homo sapiens
agcgggagcaggcgcgtcagccgagctcggcggtggcgcgggcggctgggacgcagctgcccccgctcggcgcccgctgcacccttagcagccactgccacctgggcccggagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaaccctgctcattgttgttctctcctggctttccttctggatcaacccggacgcgagtgctgccagagtgcccctgggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtcaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttcaaaatatattaatttgtaaaatcagctcgttttaaagtgtgcttgtgttgtcaaaaatatcagatagtaatacacagtgagcatttttaaacaaagggaaacctatatttatgtaactgtatactgaattctgacaaaataaaaaaagataccttattgacgaaatatttaggataaacaaaattctatttaatccaccttaaaacctaaatgtattttcatggatttcatttgttggtacatattacacaaaacattgtgccttaaaatgagtcatacatcttttaaattggaatgcagtaatagatatgtgattttacatcatttttaagaaaccaaggggaagtaataagttgaaaaagaaatccataactattaaaagattttaacttttttattttattaaaatgcttgcatattttaagtaaaattaaaaatgtttactgaatttatttttttatttgaatattttgggattagttacaaaatatttagagattaaataaataatagctttgtttgtgttagacttcacttctacttgtattttctttcttgttaaaagtctagacaactgagatttacttactttgaacttgttccaatccaaaagtaagcactaagtctcattttatgagaccaccatttcttaatatcacatccagtgcacctttgtctttctgccatatctgaaataaaactatcagtaattcacatagataaacataagactaaagaagtatatttacattatctggagagttttgttgcagctacgagtttgtatggcaaattcaataataaagtattgtttatgcaaattgccatatgtaattcagtgctattcaatttattgaagccttgcatttttaaaagattctcactgattatattatttttaatgggatataatcgaatcctttgtagtccttcagcaccctctagttgtaaaggtgatatccggataattttacagtgctacag

SEQ ID NO: 449436 - DNA, 2519 bp, Homo sapiens
agcgggagcaggcgcgtcagccgagctcggcggtggcgcgggcggctgggacgcagctgcccccgctcggcgcccgctgcacccttagcagccactgccacctgggcccggagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaaccctgctcattgttgttctctcctggctttccttctggatcaacccggacgcgagtgctgccagagtgcccctgggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtcaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttcaaaatatattaatttgtaaaatcaaaaaaaaagaaaacaggacagcacacacagcaccacaacagccagaacaaacaaaaagaagaggcgcgcgccaccaaaaaacaataagggaaggcgcatcaagagcagccatgcccgatagaaacaagcgccaacgttaatattacaaagcgccatagagcgtctacatacgacacgagagcgacgagtcatgggaacaagatcgagcgggaaaacaaaccacaaagggacgcaacacccgcgtgtgcacacacatgtggtcagacgcctcacatacc

SEQ ID NO: 449437 - DNA, 2908 bp, Homo sapiens
agcgggagcaggcgcgtcagccgagctcggcggtggcgcgggcggctgggacgcagctgcccccgctcggcgcccgctgcacccttagcagccactgccacctgggcccggagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaaccctgctcattgttgttctctcctggctttccttctggatcaacccggacgcgagtgctgccagagtgcccctgggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtcaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttcaaaatatattaatttgtaaaatcagctcgttttaaagtgtgcttgtgttgtcaaaaatatcagatagtaatacacagtgagcatttttaaacaaagggaaacctatatttatgtaactgtatactgaattctgacaaaataaaaaaagataccttattgacgaaatatttaggataaacaaaattctatttaatccaccttaaaacctaaatgtattttcatggatttcatttgttggtacatattacacaaaacattgtgccttaaaatgagtcatacatcttttaaattggaatgcagtaatagatatgtgattttacatcatttttaagaaaccaaggggaagtaataagttgaaaaagaaatccataactattaaaagattttaacttttttattttattaaaatgcttgcatattttaagtaaaattaaaaatgtttactgaatttatttttttatttgaatattttgggattagttacaaaatatttagagattaaataaataatagctttgtttgtgttagacttcacttctacttgtattttctttcttgttaaaagtctagacaactgagatttacttactttgaacttgttccaatccaaaagtaagcactaagtctcattttatgagaccaccatttcttaatatcacatccagtgcacctttgtctttctgccatatctgaaataaaactatcagtaattcacatagataaacataagactaaagaagtatatttacattatctggagagttttgttgcagctacgagtttgtatggcaaattcaataataaagtattgtttatgcaaattgccatatgtaattcagtgctattcaatttattgaagccttgcatttttaaaagattctcactgattatattatttttaatgggatataatcgaatcctttgtagtccttcagcaccctctagttgtaaaggtgatatccggataattttacagtgctacag

SEQ ID NO: 449438 - DNA, 2126 bp, Homo sapiens
agcgggagcaggcgcgtcagccgagctcggcggtggcgcgggcggctgggacgcagctgcccccgctcggcgcccgctgcacccttagcagccactgccacctgggcccggagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatcgttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtcaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttcaaaatatattaatttgtaaaatcagctcgttttaaagtgtgcttgtgttgtcaaaaatatcagatagtaatacacagtgagcatttttaaacaaagggaaacctatatttatgtaactgtatactgaattctgacaaaataaaaaaagataccttattgacgaaatatttaggataaacaaaattctatttaatccaccttaaaacctaaatgtattttcatggatttcatttgttggtacatattacacaaaacattgtgccttaaaatgagtcatacatcttttaaattggaatgcagtaatagatatgtgattttacatcatttttaagaaaccaaggggaagtaataagttgaaaaagaaatccataactattaaaagattttaacttttttattttattaaaatgcttgcatattttaagtaaaattaaaaatgtttactgaatttatttttttatttgaatattttgggattagttacaaaatatttagagattaaataaataatagctttgtttgtgttagacttcacttctacttgtattttctttcttgttaaaagtctagacaactgagatttacttactttgaacttgttccaatccaaaagtaagcactaagtctcattttatgagaccaccatttcttaatatcacatccagtgcacctttgtctttctgccatatctgaaataaaactatcagtaattcacatagataaacataagactaaagaagtatatttacattatctggagagttttgttgcagctacgagtttgtatggcaaattcaataataaagtattgtttatgcaaattgccatatgtaattcagtgctattcaatttattgaagccttgcatttttaaaagattctcactgattatattatttttaatgggatataatcgaatcctttgtagtccttcagcaccctctagttgtaaaggtgatatccggataattttacagtgctacag

SEQ ID NO: 449439 - DNA, 3179 bp, Homo sapiens
  misc_feature (1)..(2): n is a, c, g, or t
  misc_feature (4)..(6): n is a, c, g, or t
  misc_feature (38)..(38): n is a, c, g, or t
  misc_feature (65)..(65): n is a, c, g, or t
nncnnngcggcgtgccgggaggacgcgcgctgccctgngcgggagagggcgcggggcgcctggcngcggcagccgggtccccgctgcggtggcgcccgcggagacgctccgggtggagagatgcagagggccgggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaaccctgctcattgttgttctctcctggctttccttctggatcaacccggacgcgagtgctgccagagtgcccctgggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtcaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttcaaaatatattaatttgtaaaatcagctcgttttaaagtgtgcttgtgttgtcaaaaatatcagatagtaatacacagtgagcatttttaaacaaagggaaacctatatttatgtaactgtatactgaattctgacaaaataaaaaaagataccttattgacgaaatatttaggataaacaaaattctatttaatccaccttaaaacctaaatgtattttcatggatttcatttgttggtacatattacacaaaacattgtgccttaaaatgagtcatacatcttttaaattggaatgcagtaatagatatgtgattttacatcatttttaagaaaccaaggggaagtaataagttgaaaaagaaatccataactattaaaagattttaacttttttattttattaaaatgcttgcatattttaagtaaaattaaaaatgtttactgaatttatttttttatttgaatattttgggattagttacaaaatatttagagattaaataaataatagctttgtttgtgttagacttcacttctacttgtattttctttcttgttaaaagtctagacaactgagatttacttactttgaacttgttccaatccaaaagtaagcactaagtctcattttatgagaccaccatttcttaatatcacatccagtgcacctttgtctttctgccatatctgaaataaaactatcagtaattcacatagataaacataagactaaagaagtatatttacattatctggagagttttgttgcagctacgagtttgtatggcaaattcaataataaagtattgtttatgcaaattgccatatgtaattcagtgctattcaatttattgaagccttgcatttttaaaagattctcactgattatattatttttaatgggatataatcgaatcctttgtagtccttcagcaccctctagttgtaaaggtgatatccggataattttacagtgctacag

SEQ ID NO: 449440 - DNA, 2822 bp, Homo sapiens
tatttgtgccactaatcattgtaaccctttttgttttggggccgaataagttcttaaaaatagcaataaacatacacatgtgcacgcatgtactttttcttcaggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaaccctgctcattgttgttctctcctggctttccttctggatcaacccggacgcgagtgctgccagagtgcccctgggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtcaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttcaaaatatattaatttgtaaaatcagctcgttttaaagtgtgcttgtgttgtcaaaaatatcagatagtaatacacagtgagcatttttaaacaaagggaaacctatatttatgtaactgtatactgaattctgacaaaataaaaaaagataccttattgacgaaatatttaggataaacaaaattctatttaatccaccttaaaacctaaatgtattttcatggatttcatttgttggtacatattacacaaaacattgtgccttaaaatgagtcatacatcttttaaattggaatgcagtaatagatatgtgattttacatcatttttaagaaaccaaggggaagtaataagttgaaaaagaaatccataactattaaaagattttaacttttttattttattaaaatgcttgcatattttaagtaaaattaaaaatgtttactgaatttatttttttatttgaatattttgggattagttacaaaatatttagagattaaataaataatagctttgtttgtgttagacttcacttctacttgtattttctttcttgttaaaagtctagacaactgagatttacttactttgaacttgttccaatccaaaagtaagcactaagtctcattttatgagaccaccatttcttaatatcacatccagtgcacctttgtctttctgccatatctgaaataaaactatcagtaattcacatagataaacataagactaaagaagtatatttacattatctggagagttttgttgcagctacgagtttgtatggcaaattcaataataaagtattgtttatgcaaattgccatatgtaattcagtgctattcaatttattgaagccttgcatttttaaaagattctcactgattatattatttttaatgggatataatcgaatcctttgtagtccttcagcaccctctagttgtaaaggtgatatccggataattttacagtgctacag

SEQ ID NO: 449441 - DNA, 2481 bp, Homo sapiens
ggcggcgctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaaa

SEQ ID NO: 449442 - DNA, 4331 bp, Homo sapiens
  misc_feature (482)..(483): n is a, c, g, or t
ggcggcgctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggattttaaataaacttggagccttttcttgaaagacagctggctgtnnagagccttctaccaactgcagttttagatacgttttgaaaatttcatcacctgagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaaggtggatcatttaacaaaaaataagtagctttattaaagaaaaatcttcaacacaatcaaactttaacattttagcttttagatttttatgtgtctttgacagctagtgtctagtgtatgaaagtggaaaaggacatttctgtagtagctgttaagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatcattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaacatgaaaatgctggtgagctgaggtagaaaaaaaacaagaaaaaaattttaaaaatagcgttaaaatgcattttaggctcctaatgtcgttaatttgcacgttaaagacctctaatcgcatgcaagcattgacctaccacacctacatcccactgtgcctgcattattgaaattactactcactttaattttttttcccctttttactgtttgataccaatcataatcagtctgatactagaatcatgattggttttgttctttagtactgtctagagctactattttgtttttattgctgtccgccacttgatagtcatacatctagtatgtgtttgtactatttagtattgcattcattggacgtactattcaacgaatttgtctccttactgttaccaagggtcttggaatttttatattttaaattaatcattcaatataagttatttataggtatagtacaattttaaaatatttagaatgctacaatcattggttcaaactattgattcatgggaaaatttaaattcataagaataatatgtatagggataagttgatatttaatgtattggcactttaacttgggcagacatgttttcttattggtttaaagaagtaataagtattttaatatttttactatgaaatgggatccaattttagaaatgaattgctacttttctctttagtgtgtacactttaagttttagatggaattatgaaatattcactttacgttattttgttacaataataagttttatatttcttattatcaagcaagagttgccacctggacagagtttacattgatactcaatatttttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaactattgattcaatttatcatcagtgtttatttctattgtatctagttatctatccaaataattgtattggcttagcggagactgtatgttaagtgtattagttttagattgtgaaattgtgcagtttaggtaaacatcaaatccctttatttttgtacagcagatttccagcattagaaccatgtagaacaaatatactagatgttaaagattacacaataaaggaacttggcaaaccaaaaaaaaa

SEQ ID NO: 449443 - DNA, 2949 bp, Homo sapiens
ggcggcgctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaaacttaatcatgtatgtgtaattcctcttttaccctggccttttaaaacactgtgccgttgtaatgagacgtttctcatagggaaagatgttagtctcttttaattggacaacactgtcactcaaggcatagatgaaactttccttccattagaaagactaaaagatttaattcttggttgtaccttaatctattttttaaataggtttctttcaggctgcttatttttcattaagatgtgtatcagcttggatttgcctactgtttaattaaaatatttattgtcaaagtttgacaatctaacactctatggtaggggtgtgtgtgtgtgtgtttgtgagtgtgtgtttgcctgtgatttttaattggcccatgtctttagaatccaagtggttaagatgtatttgtgatttgaaatatagcatgttgataatatttagctgttggcctttacaaataactttcaaagc

SEQ ID NO: 449444 - DNA, 2427 bp, Homo sapiens
ggcggcgctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttttgtaaatttgagacttatgtaagcgtgatttcaaaccataattcgtgttgtaaatcagactccagcaatttttgttgtatgattttgtttttttgtaaagtgtaattgtccttgtacaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaaa

SEQ ID NO: 449445 - DNA, 1739 bp, Homo sapiens
ggcggcgctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagtaagttacattctgtacactcttatgctttatgtcagtgtatgaaaatgttaggtattcattgataaaatgtttgtttgcctaatttctgaactgatgcagttatctgtgttttaacctgtgatttcaatttttttttagtattagaatatctagagtttgtttagacataggtatcagtatcattgtaactaattgcagtgagggttgtctttattggaa

SEQ ID NO: 449446 - DNA, 2347 bp, Homo sapiens
ttctcataatgtattatgatgtaggggagggaggaaggagggccagggtagggggcacaccctctccctgaatgaaattcatttaggggcactgtctgctcgcatgttctgttctgggagaaaatgggtagcagaagctacaatttgtactaagctaatgaaaagagagaaaagaagaatggggaagagaagggcaaagaaggcaaaaagagaagagaagaaaaagggaggagagagaaggagaaatgagaaaagaggaaaccaaatgaagaggatgtgtgagagaaaaaaatatgaaacagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaaa

SEQ ID NO: 449447 - DNA, 2828 bp, Homo sapiens
ggcggcgctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaaaaaaaaaacaaaaaaacagaaaaagaaaaaaaaacacaaaaaaagaagtaaaagaaaaaagaaggggggggggctacaaaagaactcccctgaggggggccaacagatatacggagcgacgcacaatatgcataggaacaaagggagccccaaatgggagaagcaaaataaaagagaagaacgagcgcagacaataaaaaacgtgatgtacagtcgaaacaacgcgaacaagagaacattcggaaagacgaccccataaacccggaggggaacacacactgggcgacaaccacccaaagaagatataaacgcccgagggaaaataaaagcatcagggggacaagcgcg

SEQ ID NO: 449448 - DNA, 2269 bp, Homo sapiens
ggcggcgctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtagggattgaatgctgtaagcagccctcttacggcttcgaggtcccgagttcagaaatgagcaaccagggtccaaacccccggggcaaacggtttgaccttagacccc

SEQ ID NO: 449449 - DNA, 1777 bp, Homo sapiens
tgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcc

SEQ ID NO: 449450 - DNA, 792 bp, Homo sapiens
acacaggttgctgggaagtaggagaaagctggcagccacaggcctcacccagctcccatgcagcccacagccctaaaggccggtttcactcccaccatgccccaccaacagcaatgagtttacttccaggaagctggtgagcagggctgagaacttgctccaggctacaagcctcccagctgagaaaacgagcgaactcacagttcctcgactgtcccatggagcctgcagtggcaatccgcctccttcaaagggtctgtggactttctcggctttcctgatctcagaaacacagcttttacaaaggataaatgaagagaaattcaccagagatacattgtaatgaatctgtaaatcaccaaagctaaagatattatttcacaagtggaatgacagctgacttctcaacaacaacgaaagcaaggagacagttgaaagacatcttgaaaatggaattagcagttcacaaagcacattcgcatataagggcttgttttgaattgatcttggcagcaattctatgagacaagtaaaagcacaagaggaataggaactgcacctcttccttcagtttcagcttgaataatatcaggaagattcgtatcggtctgagttgggtcacgtacccgacgtgctatagctgaggatgggagcgttggggaccttgtctggcttgttcccaatgcctggaagagtgcctggcacacaggattaagccaacacatatgttttgaatgaatgtgtgcacacatgcatgagctggcggcagtcggggttggggtaagcacgaag

SEQ ID NO: 449451 - DNA, 801 bp, Homo sapiens
agcggagattgctcgcgcagagtcgtgataaagctgaggacttgatacgcgtgttcgcaacctcccatgcagcccacagccctaaaggccggtttcactcccaccatgccccaccaacagcaatgagtttacttccaggaagctggtgagcagggctgagaacttgctccaggctacaagcctcccagctgagaaaacgagcgaactcacagttcctcgactgtcccatggagcctgcagtggcaatccgcctccttcaaagggtctgtggactttctcggctttcctgatctcagaaacacagcttttacaaaggataaatgaagagaaattcaccagagatacattgtaatgaatctgtaaatcaccaaagctaaagatattatttcacaagtggaatgacagctgacttctcaacaacaacgaaagcaaggagacagttgaaagacatcttgaaaatggaattagcagttcacaaagcacattcgcatataagggcttgttttgaattgatcttggcagcaattctatgagacaagtaaaagcacaagaggaataggaactgcacctcttccttcagtttcagcttgaataatatcaggaagattcgtatcggtctgagttgggtcacgtacccgacgtgctatagctgaggatgggagcgttggggaccttgtctggcttgttcccaatgcctggaagagtgcctggcacacaggattaagccaacacatatgttttgaatgaatgtgtgcacacatgcatgagctggcggcagtcggggttggggtaagcacgaag

SEQ ID NO: 449452 - DNA, 2248 bp, Homo sapiens
  misc_feature (1796)..(1796): n is a, c, g, or t
tgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgccaaaaaaaataaaaaaatanacctctccgaattcggcacgagggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctgggccttagcccaatatgctgtcttgggtcctattcaaataaagttatttctcctggtctcaaaaaa

SEQ ID NO: 449453 - DNA, 1840 bp, Homo sapiens
tgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttagctgacttgtatgaagaaggaggtggaggaggaggagaaggtgaagacaatgctgactcaaaggagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcc

SEQ ID NO: 449454 - DNA, 2335 bp, Homo sapiens
agcggagattgctcgcgcagagtcgtgataaagctgaggacttgatacgcgtgttcgcaacctcccatgcagcccacagccctaaaggccggtttcactcccaccatgccccaccaacagcaatgagtttacttccaggaagctggtgagcagggctgagaacttgctccaggctacaagcctcccagctgagaaaacgagcgaactcacagttcctcgactgtcccatggagcctgcagtggcaatccgcctccttcaaagggtctgtggactttctcggctttcctggaattagcagttcacaaagcacattcgcatataagggcttgttttgaattgatcttggcagcaattctatgagacaagtaaaagcacaagaggaataggaactgcacctcttccttcagtttcagcttgaataatatcaggaagattcgtatcggtctgagttgggtcacgtacccgacgtgctatagctgaggatgggctgacttgtatgaagaaggaggtggaggaggaggagaaggtgaagacaatgctgactcaaaggggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacaagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcc

SEQ ID NO: 449455 - DNA, 3715 bp, Homo sapiens
agcggagattgctcgcgcagagtcgtgataaagctgaggacttgatacgcgtgttcgcaacctcccatgcagcccacagccctaaaggccggtttcactcccaccatgccccaccaacagcaatgagtttacttccaggaagctggtgagcagggctgagaacttgctccaggctacaagcctcccagctgagaaaacgagcgaactcacagttcctcgactgtcccatggagcctgcagtggcaatccgcctccttcaaagggtctgtggactttctcggctttcctggaattagcagttcacaaagcacattcgcatataagggcttgttttgaattgatcttggcagcaattctatgagacaagtaaaagcacaagaggaataggaactgcacctcttccttcagtttcagcttgaataatatcaggaagattcgtatcggtctgagttgggtcacgtacccgacgtgctatagctgaggatgggctgacttgtatgaagaaggaggtggaggaggaggagaaggtgaagacaatgctgactcaaaggggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacaagacgatctgccgaccctctgggagaaaatccagcaagatgcaagccttcagaatctgggatgttaaccagaagaccttctatctgaggaacaaccaactagttgctggatacttgcaaggaccaaatgtcaatttagaaggtgagtggttgccaggaaagccaatgtatgtgggcatcacgtcactttgcccgtctgtctgcagcagcatggcctgcctgcacaaaccctaggtgcaatgtcctaatccttgttgggtctttgtattcaagtttgaagctgggagggcctggctactgaagggcacatatgagggcagcctgaagagggtgtggagaggtagagtctaggtcagaggtcagtgcctataggcacagtggtcccagggccacagctgggaagggcaaataccagaaggcaaggttgaccattcccttcctcaagtgcctattaaggctccatgttcctatgttgttcaaaccctaactcaatcccaaattaatccaccatgtataaggttgagctatgtctcttattcctggacaccatactcagccatattctggtccacacattaaacaagctggatgaccttgaagaagcttcacccactctgttcctcagctttcccttcagtgggatgatatcaactggacaacaggatgtgcgattcttttagttccagccttccaggatgttttcactcccctgtttgttgttgtaggatggtattacctccaccttcccaccttccctatgccctggttctgtctcctgtgcctcgctctgaaagtggatgagacctacaattcctgtcctggtagttctcctaatgaacacactgaagcacgaggaagctgagatttttgttgctacatgagagcatggaggcctcttagggagagaggaggttcagagactcctaggctcctgtggagccccactcatggccttgttcattttccctgcccctcagcaacactcctattgacctggagcacaggtatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcttggtttaatcttctatttacctgcagaccaggaagatgagacctctctgcccttctgacctcgggattttagttttgtggggaccaggggagatagaaaaatacccggggtctcttcattattgctgcttcctcttctattaacctgaccctcccctctgttcttccccagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcc

SEQ ID NO: 449456 - DNA, 1428 bp, Homo sapiens
  misc_feature (21)..(21): n is a, c, g, or t
tacgggcacgcgaccgcgcgncgggaagaggccggccgtgcagtcggtgagagaccagacccagcggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcc

SEQ ID NO: 449457 - DNA, 1364 bp, Homo sapiens
tgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttctacagcagccccagatcaccaaccacaacactctcacctgccagcatgacaagcctaggcgtcggtgaagaattcaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagctcgtggaggcatctacacccacccacagcagcactggctcgctacacacaacactgacccctgccagctccacaagcgctggccttcaggaagaatctaccacctttccagagctggccaagctcaagtgacacaacaccttcacccccggcacccac

SEQ ID NO: 449458 - DNA, 593 bp, Homo sapiens
agcggagattgctcgcgcagagtcgtgataaagctgaggacttgatacgcgtgttcgcaacctcccatgcagcccacagccctaaaggccggtttcactcccaccatgccccaccaacagcaatgagtttacttccaggaagctggtgagcagggctgagaacttgctccaggctacaagcctcccagctgagaaaacgagcgaactcacagttcctcgactgtcccatggagcctgcagtggcaatccgcctccttcaaagggtctgtggactttctcggctttcctggaattagcagttcacaaagcacattcgcatataagggcttgttttgaattgatcttggcagcaattctatgagacaagtaaaagcacaagaggaataggaactgcacctcttccttcagtttcagcttgaataatatcaggaagattcgtatcggtctgagttgggtcacgtacccgacgtgctatagctgaggatggggtaagctgattggagtttgcaacactgttcacagagccaagatatggaaagaacctaaatgtcaactggtggatgaatggataaagaaattgtggtatatacata

SEQ ID NO: 449459 - DNA, 254 bp, Homo sapiens
ctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctatattgttgactatgtc

SEQ ID NO: 449460 - DNA, 1741 bp, Homo sapiens
atttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcc

SEQ ID NO: 449461 - DNA, 1948 bp, Homo sapiens
tgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttagggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacaagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcc

SEQ ID NO: 449462 - DNA, 2011 bp, Homo sapiens
tgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttagctgacttgtatgaagaaggaggtggaggaggaggagaaggtgaagacaatgctgactcaaaggggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacaagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcc

SEQ ID NO: 449463 - DNA, 3121 bp, Homo sapiens
atttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaaggtgagtggttgccaggaaagccaatgtatgtgggcatcacgtcactttgcccgtctgtctgcagcagcatggcctgcctgcacaaaccctaggtgcaatgtcctaatccttgttgggtctttgtattcaagtttgaagctgggagggcctggctactgaagggcacatatgagggcagcctgaagagggtgtggagaggtagagtctaggtcagaggtcagtgcctataggcacagtggtcccagggccacagctgggaagggcaaataccagaaggcaaggttgaccattcccttcctcaagtgcctattaaggctccatgttcctatgttgttcaaaccctaactcaatcccaaattaatccaccatgtataaggttgagctatgtctcttattcctggacaccatactcagccatattctggtccacacattaaacaagctggatgaccttgaagaagcttcacccactctgttcctcagctttcccttcagtgggatgatatcaactggacaacaggatgtgcgattcttttagttccagccttccaggatgttttcactcccctgtttgttgttgtaggatggtattacctccaccttcccaccttccctatgccctggttctgtctcctgtgcctcgctctgaaagtggatgagacctacaattcctgtcctggtagttctcctaatgaacacactgaagcacgaggaagctgagatttttgttgctacatgagagcatggaggcctcttagggagagaggaggttcagagactcctaggctcctgtggagccccactcatggccttgttcattttccctgcccctcagcaacactcctattgacctggagcacaggtatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcttggtttaatcttctatttacctgcagaccaggaagatgagacctctctgcccttctgacctcgggattttagttttgtggggaccaggggagatagaaaaatacccggggtctcttcattattgctgcttcctcttctattaacctgaccctcccctctgttcttccccagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcc

SEQ ID NO: 449464 - DNA, 1723 bp, Homo sapiens
tgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaactccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcc

SEQ ID NO: 449465 - DNA, 5310 bp, Homo sapiens
cgcattgttttcctccgcggatccgcggctggacttggacccagggctctcccgacagcgccctggaacccaaattcaagcaccatccaattcggacgctcatcgcatctcgcctgagcacaaccacggattgcgaactcagcgcagcgcgtggccgctggccgcccgcggcgatctcgatcccgctgacccgaatcctggagcaagtaccccgggcagggaaggggctgcggggaggcggggagggagcaggagggcgcggccggcggggggcaagcttctgaagcgctaggggaccagggaggtgtcggcgcccggtgtgcctggctgacggagagggtcaacgaaattggggtgcagggaggaaggagggacagtggccgagccccgtaactgtactggtgagagcagagtctgggcacctcgttcaattgggctttcgtcgagtcgcatcccgctggactgggaagcgcgaaaagggattatttgaggcgcgctccgtagagagcgtggaaaacctggccccttgctttcccagcaaggaaactagggctccgagacccacggagaactagaccctcctgacgcccctgaagggatgggaagagggacgcatcgttccggactttgtgtcacgggtgctcctctgtccttgtgcaagccggaatctgagcaccctctgaagggttggctcgtgcaaagaggcggcgaatggggccctcgagcaacatcggtcccagcgcctatctccttccttcagcccgctcggcccggggctttgttagactgaggtctcccaaggaggacatccgagctggcaactgcctcctgagcccacggtccccactgagcgccggcctcaggcccgccctcgtcggttctcagcctctggccctgtttccctggcctgggagacccgcctccgctccccaacccccgctcctatcccctcttcgtctgcgcctgcaggcccctccagcccctcctctcgctaacgtggctctgggacccggtcccggcccagactctgctaccggcccctcctcggagccccggatccggtgagggggagacaggtcgagcccctggccctaggcccacctcttttcgaggctttagacacctggattgtcctggttgggggttgggtgggaaggagggtaggtgctgagtgtggggctaagagctaagagtgggggaaatggcttggagaaaggaaagctccggttccacaggctccttggcgcgaccctgctccctctgaggaaggtggactggggcgggcgaccagcccaaaggcttcctgctattgtccccagcccagtctccccttctccatcccttccacagctctcctagactctggctgtgaccccagccattccccagaggtggcttcggggccaggagagagaagggctgtttcctcttcccagcaacgggaggatctggaaaggggagagtcggccaggtctctcccatgtgcttcagatggggtgtgtgaagcagctcggattcttccagggcagagtgatcttttctccaggccaggagttgaggagctgaccagatgctgcttcccagaaacagctacaagaagccctcttaaaggtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcgagactccggggctcccgcgccctctctccctccgcagtttggcccggctccacggtgggggcccagagcccccgccgccctccaaggacggggacgcggtgcagacgccgcagctctacaccaccttcctgccgcctccggagggcgtgcccccgccggagctggcctgcctgcccacccccgagtccacgccggagctgccggtcaagcacctccgcgccgccggggacccctgggagtggaaccagaacaggaacaacgccaaggagggtccgggccgctcacggggcgggcacgcggcgggcgggcccgcgccccgcgtgctggtgaggccaccgccgcccggctgtcccgggcaggccgtggaagtcaccaccctggaggaactgctgcgctacctgcacggcccgcagccgcccagaaagggggccgagccccccgcccctttaacctcgcgggcgctcccgccggagcccgcccccgccctcttgggcggccccagccccaggccccacgagtgcgcctcgccgctgaggctggacgtgccccccgagggcaggtgcgcctctgcccccgcccggcccgcgctctccgcccccgctccccggctgggcgtcggcggaggccggaggttgcctttctccggccaccgggccccccctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggtccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggcctcctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggccctgggctctcccgggtaatgggatggctgcggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgttaaaaaaaaaaaccaagggcggccgct

SEQ ID NO: 449466 - DNA, 3211 bp, Homo sapiens
cgcattgttttcctccgcggatccgcggctggacttggacccagggctctcccgacagcgccctggaacccaaattcaagcaccatccaattcggacgctcatcgcatctcgcctgagcacaaccacggattgcgaactcagcgcagcgcgtggccgctggccgcccgcggcgatctcgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcgagactccggggctcccgcgccctctctccctccgcagtttggcccggctccacggtgggggcccagagcccccgccgccctccaaggacggggacgcggtgcagacgccgcagctctacaccaccttcctgccgcctccggagggcgtgcccccgccggagctggcctgcctgcccacccccgagtccacgccggagctgccggtcaagcacctccgcgccgccggggacccctgggagtggaaccagaacaggaacaacgccaaggagggtccgggccgctcacggggcgggcacgcggcgggcgggcccgcgccccgcgtgctggtgaggccaccgccgcccggctgtcccgggcaggccgtggaagtcaccaccctggaggaactgctgcgctacctgcacggcccgcagccgcccagaaagggggccgagccccccgcccctttaacctcgcgggcgctcccgccggagcccgcccccgccctcttgggcggccccagccccaggccccacgagtgcgcctcgccgctgaggctggacgtgccccccgagggcagggagcggtccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggcctcctgggtctgggacgtgcctctcctactgtgtaggagcctccgcttcccaatacagccgtgtctgc

SEQ ID NO: 449467 - DNA, 2270 bp, Homo sapiens
cgcattgttttcctccgcggatccgcggctggacttggacccagggctctcccgacagcgccctggaacccaaattcaagcaccatccaattcggacgctcatcgcatctcgcctgagcacaaccacggattgcgaactcagcgcagcgcgtggccgctggccgcccgcggcgatctcgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatggtgagtcctcttgtcccaacctcaccttcccttgctcagcccacatacctgagtgtgtgtcctgtagcagcagcagagcagcattctgaataccctgggagtatcggaaaagggtcggcatcctccagatacccagcatgtagctcagtacttggcacacagtagggtactttttgaacaaataaatcaatgtcctgcatgatga

SEQ ID NO: 449468 - DNA, 303 bp, Homo sapiens
ctcccagtgaccccctttgccaaggctagccctgtagttctagcagtttctagaaaggggccatccccttcccctgcatctctgggcataaagccaccagcacctttgtaaccaaactattaagaagtgtcatcagccccctcccattttcaaggcagcatctcccctacccaagcgtcagcagacttttcttgaatttttacatttacttgtaagggatgtggtaaggggagcataatgcagtctcttctctcctttgtcctgtcttccatcaggtcagaggtttcctatccccctcaagcc

SEQ ID NO: 449469 - DNA, 3526 bp, Homo sapiens
cgcattgttttcctccgcggatccgcggctggacttggacccagggctctcccgacagcgccctggaacccaaattcaagcaccatccaattcggacgctcatcgcatctcgcctgagcacaaccacggattgcgaactcagcgcagcgcgtggccgctggccgcccgcggcgatctcgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcgagactccggggctcccgcgccctctctccctccgcagtttggcccggctccacggtgggggcccagagcccccgccgccctccaaggacggggacgcggtgcagacgccgcagctctacaccaccttcctgccgcctccggagggcgtgcccccgccggagctggcctgcctgcccacccccgagtccacgccggagctgccggtcaagcacctccgcgccgccggggacccctgggagtggaaccagaacaggaacaacgccaaggagggtccgggccgctcacggggcgggcacgcggcgggcgggcccgcgccccgcgtgctggtgaggccaccgccgcccggctgtcccgggcaggccgtggaagtcaccaccctggaggaactgctgcgctacctgcacggcccgcagccgcccagaaagggggccgagccccccgcccctttaacctcgcgggcgctcccgccggagcccgcccccgccctcttgggcggccccagccccaggccccacgagtgcgcctcgccgctgaggctggacgtgccccccgagggcaggtgcgcctctgcccccgcccggcccgcgctctccgcccccgctccccggctgggcgtcggcggaggccggaggttgcctttctccggccaccgggccccccctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggtccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggcctcctgggtctgggacgtgcctctcctactgtgtaggagcctccgcttcccaatacagccgtgtctgc

SEQ ID NO: 449470 - DNA, 2363 bp, Homo sapiens
cgcattgttttcctccgcggatccgcggctggacttggacccagggctctcccgacagcgccctggaacccaaattcaagcaccatccaattcggacgctcatcgcatctcgcctgagcacaaccacggattgcgaactcagcgcagcgcgtggccgctggccgcccgcggcgatctcgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatggcgtgcgccgggacctgcccccagcctcggcctcccgctccggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgttaaaaaaaaaaaccaagggcggccgct

SEQ ID NO: 449471 - DNA, 2444 bp, Homo sapiens
cgcattgttttcctccgcggatccgcggctggacttggacccagggctctcccgacagcgccctggaacccaaattcaagcaccatccaattcggacgctcatcgcatctcgcctgagcacaaccacggattgcgaactcagcgcagcgcgtggccgctggccgcccgcggcgatctcgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaaggtaaacagaagaggcagctgctgttgcagccaaagctgcacatggccatgatggccacagacaccatcccaggcttggccttttgtccttctctccttctgtggcacagtcaccccatcagttcttcatgaagcttctctttccccccatcttcaccctgtcccttcttcatagatggagctactgggagtcagtctggccctggggattctgcttatggtgagtcctcttgtcccaacctcaccttcccttgctcagcccacatacctgagtgtgtgtcctgtagcagcagcagagcagcattctgaataccctgggagtatcggaaaagggtcggcatcctccagatacccagcatgtagctcagtacttggcacacagtagggtactttttgaacaaataaatcaatgtcctgcatgatga

SEQ ID NO: 449472 - DNA, 2700 bp, Homo sapiens
  misc_feature (1)..(2): n is a, c, g, or t
nngggaatttatttgtccatgggcgaggctggcctgcagtctgttgccttccaggggccaagagctgctctgatcacccagggattctctctccaacccaagtgcctccagctgacctctggctcctgtcctctggctccacctgcaccgccctgctcttcctaaggggccaggaagcccccagaagctctaccatcgacgtgggtggtggcacccggctcaccctgagagcagaggccgtgcagggggctcagttctgagccccagccggcccaccatggcacggcggttccaggaggagctggccgccttcctcttcgagtatgacaccccccgcatggtgctggtgcgtaataagaaggtgggcgttatcttccgactgatccagctggtggtcctggtctacgtcatcgggtgggtgtttctctatgagaagggctaccagacctcgagcggcctcatcagcagtgtctctgtgaaactcaagggcctggccgtgacccagctccctggcctcggcccccaggtctgggatgtggctgactacgtcttcccagcccagggggacaactccttcgtggtcatgaccaatttcatcgtgaccccgaagcagactcaaggctactgcgcagagcacccagaagggggcatatgcaaggaagacagtggctgtacccctgggaaggccaagaggaaggcccaaggcatccgcacgggcaagtgtgtggccttcaacgacactgtgaagacgtgtgagatctttggctggtgccccgtggaggtggatgacgacatcccgcgccctgcccttctccgagaggccgagaacttcactcttttcatcaagaacagcatcagctttccacgcttcaaggtcaacaggcgcaacctggtggaggaggtgaatgctgcccacatgaagacctgcctctttcacaagaccctgcaccccctgtgcccagtcttccagcttggctacgtggtgcaagagtcaggccagaacttcagcaccctggctgagaagggtggagtggttggcatcaccatcgactggcactgtgacctggactggcacgtacggcactgcagacccatctatgagttccatgggctgtacgaagagaaaaatctctccccaggcttcaacttcaggtttgccaggcactttgtggagaacgggaccaactaccgtcacctcttcaaggtgtttgggattcgctttgacatcctggtggacggcaaggccgggaagtttgacatcatccctacaatgaccaccatcggctctggaattggcatctttggggtggccacagttctctgtgacctgctgctgcttcacatcctgcctaagaggcactactacaagcagaagaagttcaaatacgctgaggacatggggccaggggcggctgagcgtgacctcgcagctaccagctccaccctgggcctgcaggagaacatgaggacatcctgatgctcgggccccaactcctgactgggtgcagcgtgaggcttcagcctggagccctggtgggtcccagccagggcagaggggcctccccaggaagtctcctaccctctcagccaggcagagagcagtttgccagaagctcagggtgcatagtaggagagacctgtgcaaatctgagctccggctccgaccccacacaccctgagggaggcctaccctagcctcagccgctcctggtggggaatggctggggctgggcaggaccctcccacacacctgcaccctagcttcgtgcttctctctccggactctcattatccaacccgctgcctccatttctctagatctgtgctctccgatgtggcagtcagtaaccataggtgactaaattaaactaaaataaaatagaatgaaacacaaaattcaattcctcggctgaactagccacatttcaactgctcagtagatacgtgtggttagtggctgccatactggacagctcggggcattttcactgtcaaagaaagttctattagacagccctgcttgagccctgtttcttcctggccttcggtttccctggggaacttatcgacaatgcaagctcctgggcccacccccagacctcctgaaccaaaagctccagggctggccgtatgatctgtgtggatggcaaactccccaggccattctgggacctaagtttaagaagtgccgtcctcgaactttctgactctaagctcctgagcgggagtcagacttagccctgagcctgcacttcctgttcaggtgcagacactgaacagggtctcaaacaccttcagcatgtgtgttgtgtgctcacgtgccacacagtgtctcatgcacacaacccagtgtacacaccacctacgtgcacacagcatccttccacactgtgtatgtgaacagcttgggccctgcaaacacaaccatctacacacatctacacccccaagcacacacacatggtccgtgccatgtcacctccatagggaaaggcttctctccaagtgtgccaggccaggacagccctcccagccatgaatccttactcagctacctcgggttggggtgggagccccagccaaatcctgggctccctgcctgtggctcagccccagctcccaaggcctgcctggctctgtctgaacagaaggtctgggggaagcgaggggtggagtacaataaagggaatgaggacaaac

SEQ ID NO: 449473 - DNA, 2746 bp, Homo sapiens
  misc_feature (1)..(2): n is a, c, g, or t
nngggaatttatttgtccatgggcgaggctggcctgcagtctgttgccttccaggggccaagagctgctctgatcacccagggattctctctccaacccaagtgcctccagctgacctctggctcctgtcctctggctccacctgcaccgccctgctcttcctaaggggccaggaagcccccagaagctctaccatcgacgtgggtggtggcacccggctcaccctgagagcagaggccgtgcagggggctcagttctgagccccagccggcccaccatggcacggcggttccaggaggagctggccgccttcctcttcgagtatgacaccccccgcatggtgctggtgcgtaataagaaggtgggcgttatcttccgactgatccagctggtggtcctggtctacgtcatcgggtgggtgtttctctatgagaagggctaccagacctcgagcggcctcatcagcagtgtctctgtgaaactcaagggcctggccgtgacccagctccctggcctcggcccccaggtctgggatgtggctgactacgtcttcccagcccagggggacaactccttcgtggtcatgaccaatttcatcgtgaccccgaagcagactcaaggctactgcgcagagcacccagaagggggcatatgcaaggaagacagtggctgtacccctgggaaggccaagaggaaggcccaaggcatccgcacgggcaagtgtgtggccttcaacgacactgtgaagacgtgtgagatctttggctggtgccccgtggaggtggatgacgacatcccgcgccctgcccttctccgagaggccgagaacttcactcttttcatcaagaacagcatcagctttccacgcttcaaggtcaacaggcgcaacctggtggaggaggtgaatgctgcccacatgaagacctgcctctttcacaagaccctgcaccccctgtgcccagtcttccagcttggctacgtggtgcaagagtcaggccagaacttcagcaccctggctgagaagggtggagtggttggcatcaccatcgactggcactgtgacctggactggcacgtacggcactgcagacccatctatgagttccatgggctgtacgaagagaaaaatctctccccaggcttcaacttcaggtttgccaggcactttgtggagaacgggaccaactaccgtcacctcttcaaggtgtttgggattcgctttgacatcctggtggacggcaaggccgggaagtttgacatcatccctacaatgaccaccatcggctctggaattggcatctttggggtggccacagttctctgtgacctgctgctgcttcacatcctgcctaagaggcactactacaagcagaagaagttcaaatacgctgaggacatggggccaggggcggctgagcgtgacctcgcagctaccagctccaccctgggcctgcaggagaacatgaggacatcctgatgctcgggccccaactcctgactgggtgcagcgtgaggcttcagcctggagccctggtgggtcccagccagggcagaggggcctccccaggaagtctcctaccctctcagccaggcagagagcagtttgccagaagctcagggtgcatagtaggagagacctgtgcaaatctgagctccggctccgaccccacacaccctgagggaggcctaccctagcctcagccgctcctggtggggaatggctggggctgggcaggaccctcccacacacctgcaccctagcttcgtgcttctctctccggactctcattatccaacccgctgcctccatttctctagatctgtgctctccgatgtggcagtcagtaaccataggtgactaaattaaactaaaataaaatagaatgaaacacaaaattcaattcctcggctgaactagccacatttcaactgctcagtagatacgtgtggttagtggctgccatactggacagctcggggcattttcactgtcaaagaaagttctattagacagccctgcttgagccctgtttcttcctggccttcggtttccctggggaacttatcgacaatgcaagctcctgggcccacccccagacctcctgaaccaaaagctccagggctggccgtatgatctgtgtggatggcaaactccccaggccattctgggacctaagtttaagaagtgccgtcctcgaactttctgactctaagctcctgagcgggagtcagacttagccctgagcctgcacttcctgttcaggtgcagacactgaacagggtctcaaacaccttcagcatgtgtgttgtgtgctcacgtgccacacagtgtctcatgcacacaacccagtgtacacaccacctacgtgcacacagcatccttccacactgtgtatgtgaacagcttgggccctgcaaacacaaccatctacacacatctacacccccaagcacacacacatggtccgtgccatgtcacctccatagggaaaggcttctctccaagtgtgccaggccaggacagccctcccagccatgaatccttactcagctacctcgggttggggtgggagccccagccaaatcctgggctccctgcctgtggctcagccccagctcccaaggcctgcctggctctgtctgaacagaaggtctgggggaagcgaggggtggagtacaataaagggaatgaggacaaacctctgccgtccgtgctctctttccagacctctctgaaacacagtgt

SEQ ID NO: 449474 - DNA, 840 bp, Homo sapiens
  misc_feature (1)..(2): n is a, c, g, or t
nngggaatttatttgtccatgggcgaggctggcctgcagtctgttgccttccaggggccaagagctgctctgatcacccagggattctctctccaacccaagtgcctccagctgacctctggctcctgtcctctggctccacctgcaccgccctgctcttcctaaggggccaggaagcccccagaagctctaccatcgacgtgggtggtggcacccggctcaccctgagagcagaggccgtgcagggggctcagttctgagccccagccggcccaccatggcacggcggttccaggaggagctggccgccttcctcttcgagtatgacaccccccgcatggtgctggtgcgtaataagaaggtgggcgttatcttccgactgatccagctggtggtcctggtctacgtcatcgggtgggtgtttctctatgagaagggctaccagacctcgagcggcctcatcagcagtgtctctgtgaaactcaagggcctggccgtgacccagctccctggcctcggcccccaggtctgggatgtggctgactacgtcttcccagcccagggggacaactccttcgtggtcatgaccaatttcatcgtgaccccgaagcagactcaaggctactgcgcagagcacccagaagggggcatatgcaaggaagacagtggctgtacccctgggaaggccaagaggaaggcccaaggcatccgcacgggcaagtgtgtggccttcaacgacactgtgaagacgtgtgagatctttggctggtgccccgtggaggtggatgacgacatcccgcggtaacactctgaccttccagagagctaagaacagggtcc

SEQ ID NO: 449475 - DNA, 1708 bp, Homo sapiens
tcggaggggcctgtcccagtccatgttcgccgttgagccccagcctcttgccaccccaaagatgccaattccagagccgatggtggtcattgtagggatgatgtcaaacttcccggcctggggcaggacagagttggggtggaaccatcttggtcccctgagagtcctgcagggcctcatccaccctccaggaaactggcctccagtgaggtcagatccagccagggcctcaccaccagggactgaggtgggatgtggagggctccgtacccacccccggattcccacgctgtctccgtgcccttccctgaccccaggccacagttctctgtgacctgctgctgcttcacatcctgcctaagaggcactactacaagcagaagaagttcaaatacgctgaggacatggggccaggggcggctgagcgtgacctcgcagctaccagctccaccctgggcctgcaggagaacatgaggacatcctgatgctcgggccccaactcctgactgggtgcagcgtgaggcttcagcctggagccctggtgggtcccagccagggcagaggggcctccccaggaagtctcctaccctctcagccaggcagagagcagtttgccagaagctcagggtgcatagtaggagagacctgtgcaaatctgagctccggctccgaccccacacaccctgagggaggcctaccctagcctcagccgctcctggtggggaatggctggggctgggcaggaccctcccacacacctgcaccctagcttcgtgcttctctctccggactctcattatccaacccgctgcctccatttctctagatctgtgctctccgatgtggcagtcagtaaccataggtgactaaattaaactaaaataaaatagaatgaaacacaaaattcaattcctcggctgaactagccacatttcaactgctcagtagatacgtgtggttagtggctgccatactggacagctcggggcattttcactgtcaaagaaagttctattagacagccctgcttgagccctgtttcttcctggccttcggtttccctggggaacttatcgacaatgcaagctcctgggcccacccccagacctcctgaaccaaaagctccagggctggccgtatgatctgtgtggatggcaaactccccaggccattctgggacctaagtttaagaagtgccgtcctcgaactttctgactctaagctcctgagcgggagtcagacttagccctgagcctgcacttcctgttcaggtgcagacactgaacagggtctcaaacaccttcagcatgtgtgttgtgtgctcacgtgccacacagtgtctcatgcacacaacccagtgtacacaccacctacgtgcacacagcatccttccacactgtgtatgtgaacagcttgggccctgcaaacacaaccatctacacacatctacacccccaagcacacacacatggtccgtgccatgtcacctccatagggaaaggcttctctccaagtgtgccaggccaggacagccctcccagccatgaatccttactcagctacctcgggttggggtgggagccccagccaaatcctgggctccctgcctgtggctcagccccagctcccaaggcctgcctggctctgtctgaacagaaggtctgggggaagcgaggggtggagtacaataaagggaatgaggacaaac

SEQ ID NO: 449476 - DNA, 744 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagatttta

SEQ ID NO: 449477 - DNA, 988 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccagcccctgcctccgcatctgcgtggtgaaggccattggccctcatcggtggatctgcgtttcctcgggcctacactgtctaggattgtgcggggctggtgagagaacaagatctcttccgtgttcaaggcagacttcctgccccctgcaccctgctctctcccaggccttgaggtcagtgtgagccccaagggcaagaacacttctggaagggagagtggatttggctgggccatctggatggaaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagatttta

SEQ ID NO: 449478 - DNA, 821 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccagtgaggtcagtgtgagccccaagggcaagaacacttctggaagggagagtggatttggctgggccatctggatggaaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagatttta

SEQ ID NO: 449479 - DNA, 844 bp, Homo sapiens
cttaagcaaataacttgacctctctgagcttcagtttcttcatctgtgaaggggagatagcaatcctgatttttgagattggaatgagaattgaaggaggtcaccgtgtgtgtggacctgaccctggggaaatgtcctcagactgaggctattcaaggtcatcagaccctcagtcaaactccaatcccagcccagcacaggcccctggggtcgggagctggggccatatcctcccccacaatcctgggccctgagatctgggctagggaacccttcaggcaggggagcatgaggcctttccctccatggctgcccaggctgtgcctggagagaacagatctcggctgtaggaaatggggccagaaaggggcctcggtgattggctctggcagctcagctggcacttgccaatgctctgggattttatgctggcagatcgggggtccccaccatttcctgtcattggagcttgtggcttttctattcaaggccccacaacctgctcaggctgccgactggcttccaggatgtgcctctgggtgtgttcagtagggtcaggtggctctgggaccttaagcaagtaacattctgagtgcctgcttctccttgaggacccaccacatctgcccacagctggctgttctctcctctccaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagatttta

SEQ ID NO: 449480 - DNA, 2095 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccagcccctgcctccgcatctgcgtggtgaaggccattggccctcatcggtggatctgcgtttcctcgggcctacactgtctaggattgtgcggggctggtgagagaacaagatctcttccgtgttcaaggcagacttcctgccccctgcaccctgctctctcccaggccttgaggtcagtgtgagccccaagggcaagaacacttctggaagggagagtggatttggctgggccatctggatggaaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccaggatcttactctgagacccaggctggagtgcactggtgtgatcttggctcactgcaacctctgcctccctggcccaagcaattctcctgtctaagcctcctgagtacctggggctccaggtgtgcgccaccatgcccagctaatttttgtacttttgtagaaacagggtctcactgtgttgcccaggctggtctccaacttctgagctgaagcaatccacctgccttggcctcccaaagtgtgggattacaggcatgagccactgcacctggctgctgaagctttttaaaagagctgagggctgggatgtacttagctccacgtccagcactgagtaaatgcttaacgaatgactgtgttactaccaagaattattgtttcactctccctccttccctctcctctgctgccccaaactactcagcatcctggcactgcaggctcgcacttagccctggatacccagattcatcctcctcccctgggatggcatagaagagactttaaaaccaaatgagccaagactccaagctctgaccacacctcccaccccaccagtcttctctatgcaccccctctatctggagcccccagccaggtcctggacccaggtagctacatggcagagcatttaatgtgtgcctggcagccatgggcaccattctccacacagaaggcaggggacaggtgcacaaggcgctgagaccccagcagggctaactgtccttgtctcaggagccctacctggccagtcttgggccaggccttggggactgggagtaggggctgagccccgtctgtacagtctctggccccatgggcaccaggtgccagctcctcgcacccagtactcccattgctagggctgctggaacctgcagggtggcagagctgggcaggactcaccctataaccatgtccactgtggtgctgctgctgcagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggccccacaacctgctcaggctgccgactggcttccaggatgtgcctctgggtgtgttcagtagggtcaggtggctctgggaccttaagcaagtaacattctgagtgcctgcttctccttgaggacccaccacatctgcccacagctggctgttctctcctctccaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagatttta

SEQ ID NO: 449481 - DNA, 1101 bp, Homo sapiens
cttaagcaaataacttgacctctctgagcttcagtttcttcatctgtgaaggggagatagcaatcctgatttttgagattggaatgagaattgaaggaggtcaccgtgtgtgtggacctgaccctggggaaatgtcctcagactgaggctattcaaggtcatcagaccctcagtcaaactccaatcccagcccagcacaggcccctggggtcgggagctggggccatatcctcccccacaatcctgggccctgagatctgggctagggaacccttcaggcaggggagcatgaggcctttccctccatggctgcccaggctgtgcctggagagaacagatctcggctgtaggaaatggggccagaaaggggcctcggtgattggctctggcagctcagctggcacttgccaatgctctgggattttatgctggcagatcgggggtccccaccatttcctgtcattggagcttgtggcttttctattcaaggccccacaacctgctcaggctgccgactggcttccaggatgtgcctctgggtgtgttcagtagggtcaggtggctctgggaccttaagcaagtaacattctgagtgcctgcttctccttgaggacccaccacatctgcccacagctggctgttctctcctctccaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagattttaaaaaaaaaaaatctggaaataaaagatagaaaagtacccgccaggcaccccttccccttcttcccggacccctccccagcgggcaccgacatgaggtaactgcgcatcttctcctcctcctccctccccgcctcctgggcccccaacttggccctagcccccatgagaccttggcccaaggaagacatgggccccaaagttggagggtgatggaggtgagtacagcattggcagtgaacgcagcgtgtggcaatggt

SEQ ID NO: 449482 - DNA, 1929 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccagcccctgcctccgcatctgcgtggtgaaggccattggccctcatcggtggatctgcgtttcctcgggcctacactgtctaggattgtgcggggctggtgagagaacaagatctcttccgtgttcaaggcagacttcctgccccctgcaccctgctctctcccaggccttgaggtcagtgtgagccccaagggcaagaacacttctggaagggagagtggatttggctgggccatctggatggaaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccaggatcttactctgagacccaggctggagtgcactggtgtgatcttggctcactgcaacctctgcctccctggcccaagcaattctcctgtctaagcctcctgagtacctggggctccaggtgtgcgccaccatgcccagctaatttttgtacttttgtagaaacagggtctcactgtgttgcccaggctggtctccaacttctgagctgaagcaatccacctgccttggcctcccaaagtgtgggattacaggcatgagccactgcacctggctgctgaagctttttaaaagagctgagggctgggatgtacttagctccacgtccagcactgagtaaatgcttaacgaatgactgtgttactaccaagaattattgtttcactctccctccttccctctcctctgctgccccaaactactcagcatcctggcactgcaggctcgcacttagccctggatacccagattcatcctcctcccctgggatggcatagaagagactttaaaaccaaatgagccaagactccaagctctgaccacacctcccaccccaccagtcttctctatgcaccccctctatctggagcccccagccaggtcctggacccaggtagctacatggcagagcatttaatgtgtgcctggcagccatgggcaccattctccacacagaaggcaggggacaggtgcacaaggcgctgagaccccagcagggctaactgtccttgtctcaggagccctacctggccagtcttgggccaggccttggggactgggagtaggggctgagccccgtctgtacagtctctggccccatgggcaccaggtgccagctcctcgcacccagtactcccattgctagggctgctggaacctgcagggtggcagagctgggcaggactcaccctataaccatgtccactgtggtgctgctgctgcagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagatttta

SEQ ID NO: 449483 - DNA, 794 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggccccacaacctgctcaggctgccgactggcttccaggatgtgcctctgggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagatttta

SEQ ID NO: 449484 - DNA, 709 bp, Homo sapiens
ccctgcccataaaacagggtgtgaaaggcatctcagcggctgccccaccatggctacctgggccctcctgctccttgcagccatgctcctgggcaacccaggtaaggccttcccctcgggatcgatcctgatggcccacccagcctcgcactctcaggctggctgaacctggagcttggactctgtgggcacccaggtgcccctgcctccccccggccttctcccccgtcatggaggcctggcctcccctcagagccaggcttagtccagtgtgctgcccagcctgtcactggcctggccaaggaggagagacaggccagggattctggtcctaactctactggccacactgtgtggcctgagacccccctttccctcccaagcccctgcctccgcatctgcgtggtgaaggccattggccctcatcggtggatctgcgtttcctcgggcctacactgtctaggattgtgcggggctggtgagagaacaagatctcttccgtgttcaaggcagacttcctgccccctgcaccctgctctctcccaggccttgaggtcagtgtgagccccaagggcaagaacacttctggaagggagagtggatttggctgggccatctggatggaagaaggtaaaaaaagaaaatcccttgaaaggagattgagggaagtttctagacaaaccgacccccaaatctgtgttgctggggg

SEQ ID NO: 449485 - DNA, 762 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccaggtgaggccaaggggctacagagcctcctgtctgctgctcaatggaggggccagcctgtgaccaggtcggggatcggggagcccgggggcaccttgcacagtgatcctgggggagggcttcctagaagggaatctgtgagtccccgtgtgtctgtggatgaatttcagagaacttgtgaaattgtgactctctggaactgtgtaagtcagacggcagagtatacatggttttcatcatgtatcctcaaagagggcttgtcccagagaagttaggaatcttcccctaaagccctaacatttgtgtccaaggcagagtttgagaagctagttccccaagaggcctgggtcaggactgataaatcccagatctgctacttcca

SEQ ID NO: 449486 - DNA, 1181 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccagcccctgcctccgcatctgcgtggtgaaggccattggccctcatcggtggatctgcgtttcctcgggcctacactgtctaggattgtgcggggctggtgagagaacaagatctcttccgtgttcaaggcagacttcctgccccctgcaccctgctctctcccaggccttgaggtcagtgtgagccccaagggcaagaacacttctggaagggagagtggatttggctgggccatctggatggaagaaggtaaaaaaagaaaatcccttgaaaggagattgagggaagtttctagacaaaccgacccccaaatctgtgttgctgggggaacagaggagaagagagagtctcgccctcctggctttctagaaggaacgtgagaacacgtgtttgtgctgagagtgggtcagagcggctccagggcaaagcatgtggacaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagatttta

SEQ ID NO: 449487 - DNA, 1595 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccagcccctgcctccgcatctgcgtggtgaaggccattggccctcatcggtggatctgcgtttcctcgggcctacactgtctaggattgtgcggggctggtgagagaacaagatctcttccgtgttcaaggcagacttcctgccccctgcaccctgctctctcccaggcctgtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagcatcctggcactgcaggctcgcacttagccctggatacccagattcatcctcctcccctgggatggcatagaagagactttaaaaccaaatgagccaagactccaagctctgaccacacctcccaccccaccagtcttctctatgcaccccctctatctggagcccccagccaggtcctggacccaggtagctacatggcagagcatttaatgtgtgcctggcagccatgggcaccattctccacacagaaggcaggggacaggtgcacaaggcgctgagaccccagcagggctaactgtccttgtctcaggagccctacctggccagtcttgggccaggccttggggactgggagtaggggctgagccccgtctgtacagtctctggccccatgggcaccaggtgccagctcctcgcacccagtactcccattgctagggctgctggaacctgcagggtggcagagctgggcaggactcaccctataaccatgtccactgtggtgctgctgctgcagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggccccacaacctgctcaggctgccgactggcttccaggatgtgcctctgggtgtgttcagtagggtcaggtggctctgggaccttaagcaagtaacattctgagtgcctgcttctccttgaggacccaccacatctgcccacagctggctgttctctcctctccaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagatttta

SEQ ID NO: 449488 - DNA, 1429 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccagcccctgcctccgcatctgcgtggtgaaggccattggccctcatcggtggatctgcgtttcctcgggcctacactgtctaggattgtgcggggctggtgagagaacaagatctcttccgtgttcaaggcagacttcctgccccctgcaccctgctctctcccaggcctgtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagcatcctggcactgcaggctcgcacttagccctggatacccagattcatcctcctcccctgggatggcatagaagagactttaaaaccaaatgagccaagactccaagctctgaccacacctcccaccccaccagtcttctctatgcaccccctctatctggagcccccagccaggtcctggacccaggtagctacatggcagagcatttaatgtgtgcctggcagccatgggcaccattctccacacagaaggcaggggacaggtgcacaaggcgctgagaccccagcagggctaactgtccttgtctcaggagccctacctggccagtcttgggccaggccttggggactgggagtaggggctgagccccgtctgtacagtctctggccccatgggcaccaggtgccagctcctcgcacccagtactcccattgctagggctgctggaacctgcagggtggcagagctgggcaggactcaccctataaccatgtccactgtggtgctgctgctgcagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagatttta

SEQ ID NO: 449489 - DNA, 598 bp, Homo sapiens
tgaactttgttttcatagcaaatgattcttgtgcttccccctaccttcagtttctatgctaagcacattaaaaaaaaaacctgcctaaaaattttttttagtgggtgggaatatactgcttgggcttcagtgttgcttttgcattagatgcagattgatcagtactttgaaaatggatagcttgtttaaaatgagcctggagtgtgcgtgtatgttggctggaggggagagggggaaagttgctgacccagctataccttgagtgttaggagatgtgcagcatgcagaatttattgtgatacaccagaacatagctttggaattaagagaccagattcacataccagctgcaccagttaattgcattgtgacttcggatgggttactctccatgttttggtccttaatttttctgtctataaaatgggaatatgagctacctaccctacaaggttgctgtgagcattaagtgagaacattataggaacattcctggcacaccaacctttggttcatcccattgtaatggtgggcaccagcaaaatacattctgtggtaactgccgttctctggccggttggcacacttctaaaaaaaa

SEQ ID NO: 449490 - DNA, 1851 bp, Homo sapiens
tcatgacaaacactctgctcacacatcctcatgagttcttgccagagctgtgaaggtgaacagccaggttgaagtcatgttcaaagtcgccccggatgccctcccctctgtctcatcaggagtctcccatttccccacagccatgtcacctttgccctggcgtcgctgggctgcacacccaacagtgtctaagcaggtttctaaactataggtcagaacccactcgtgggctgtaaagtcaccttagtggatcaaaactaaaacaggaaatcagatgaagagaatgggatggaatggcaagatcatttcattaaactttagtttttattgtataaatatgtgtactgagatgaaatgtaaaatgagttttactgtggattgtagtcaaaattttttgagaaaactagtctaaggaatgttctgggcaacacactgactgatcaacacaaagtcctagacagattttgagtgaacaagctcaagttcctgttagttaaagtctggtttgttccattcaaagtcaggtacagagagaggcgcgtgcgtgtgttcggaagcacaggtgaatgtaaaggtttgtttcctctcccagcacttaggcatactgcccttttctccacagtgcccctggaggacacacggaataaagtcagcagctggcctgggcagctctgctctctgtgcttgctcacctgtgtgccccagaaagtgtctctgtgacattcctgacttcctctctgtcttttctcctttctttccattcaagaaaaccctctcttagaaacaatagtagccaacatgtgttagcacctaccatgtgctggtgttgactaaggactttatatgcattcggtcctcacaatctacaaggctctccctggagtcagcagacctggcttcagtgttcttgatgagtgagtgacttgggccagtaactcacttcccccttggaagtccagagggcaacacggcctgccctgatcttgggaggcactagaggaatgaagcagctgtgcagccaggacatgtgtgtacacagtgaggggggacacacccgtgccttcccttctcctcgggctgttttcttctctcacgtggccactgtcatcccggaactactgtggcccaactccctccctgaagccctgaacccgaagggtagggattccggagcccctgccacagagactacactacttagagagtcattccaaaagacaaaggggaacctccaaaatgccttccttttcattctgaggagtctgtcccttctgtgcatatttatagtctacacgggagtgtctgatgcaactttgaattatgcaaatgggaaatagtgcacttgtgtacaatctttatattaaaaaatgtgaaataatgcaatcaccaaaaatgttttaatttctcgagaatcacttaatttcaaaatagcttggcctacggaattataaattcttttcaccacagccagatggtagcgccactgggatagacccgtcatcctggttggtggcccgctggttcggcactgctacacacacaggattttcttcttgcaatgatggggactaatatgctgttattttaacattcactgttattataatttaaaatcttttttatatcccataacaatgtcatccaagtattcattaagtagcagtggcagtgctcgtgctgaaaaatgtacccaaaaatcaataactttggtacggaagttaaatgtgacaaaacgctatgaggaaggccaagggagcccatgataccctgggctgttaatttaggagagagcgttctgcaaggtattcaagataatgctgagaaaataaaaagtagcattaaggcaaagat

SEQ ID NO: 449491 - DNA, 1377 bp, Homo sapiens
tcatgacaaacactctgctcacacatcctcatgagttcttgccagagctgtgaaggtgaacagccaggttgaagtcatgttcaaagtcgccccggatgccctcccctctgtctcatcaggagtctcccatttccccacagccatgtcacctttgccctggcgtcgctgggctgcacacccaacagtgtctaagcaggtttctaaactataggtcagaacccactcgtgggctgtaaagtcaccttagtggatcaaaactaaaacaggaaatcagatgaagagaatgggatggaatggcaagatcatttcattaaactttagtttttattgtataaatatgtgtactgagatgaaatgtaaaatgagttttactgtggattgtagtcaaaattttttgagaaaactagtctaaggaatgttctgggcaacacactgactgatcaacacaaagtcctagacagattttgagtgaacaagctcaagttcctgttagttaaagtctggtttgttccattcaaagtcaggtacagagagaggcgcgtgcgtgtgttcggaagcacaggtgaatgtaaaggtttgtttcctctcccagcacttaggcatactgcccttttctccacagtgcccctggaggacacacggaataaagtcagcagctggcctgggcagctctgctctctgtgcttgctcacctgtgtgccccagaaagtgtctctgtgacattcctgacttcctctctgtcttttctcctttctttccattcaagaaaaccctctcttagaaacaatagtagccaacatgtgttagcacctaccatgtgctggtgttgactaaggactttatatgcattcggtcctcacaatctacaaggctctccctggagtcagcagacctggcttcagtgttcttgatgagtgagtgacttgggccagtaactcacttcccccttggaagtccagagggcaacacggcctgccctgatcttgggaggcactagaggaatgaagcagctgtgcagccaggacatgtgtgtacacagtgaggggggacacacccgtgccttcccttctcctcgggctgttttcttctctcacgtggccactgtcatcccggaactactgtggcccaactccctccctgaagccctgaacccgaagggtagggattccggagcccctgccacagagactacactacttagagagtcattccaaaagacaaaggggaacctccaaaatgccttccttttcattctgaggagtctgtcccttctgtgcatatttatagtctacacgggagtgtctgatgcaactttgaattatgcaaatgggaaatagtgcacttgtgtacaatctttatattaaaaaatgtgaaata

SEQ ID NO: 449492 - DNA, 217 bp, Homo sapiens
gggtgagcttgcacacccaacagtgtctaagcaggtttctaaactataggtcagaacccactcgtgggctgtaaagtcaccttagtggatcaaaactaaaacaggaaatcagatgaagagaatgggatggaatggcaagatcatttcattaaactttagtttttattgtataaatatgtgtactgagatgaaatgtaaaatgagttttactgtggat

SEQ ID NO: 449493 - DNA, 1432 bp, Homo sapiens
ataggagagattgaaaattaaatctcaatctctcctatgagagaggggaaaggtaatgtaaacattctagaaaggttgctttttgagagtaagtaagaaatatagcacaataacaaagtgcaggctgagtgggaaagattcttaatcagagctatttctcagaatttatctttaacataaaattagaggcaaccagatttttgttgttataactttttttatgattgaatctgtaatttcacactgattcatgctatatcaaatcagacacttatttaaagaacacattgaaaaattattttactttgcctattaattcctcccccgtattatcacactgaaacttagtaataaatctcactcttcttcctgacagatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttaagttaacaaaagaaaacatttaataaacattcaataatgattacagttttcatttttaaaaatttaggatgaaggaaacaaggaaatatagggaaaagtagtagacaaaattaacaaaatcagacatgttattcatccccaacatgggtctattttgtgcttaaaaataatttaaaaatcatacaatattaggttggttttcggttattatcaataaagctaacactgagaacattttacaaataaaaatatgagttttttagcctgaacttcaaatgtatcagctatttttaaacattatttactcggattctaatttaatgtgacattgactataagaaggtctgataaactgatgaaatggcacagcataacatttaattataatgacattctgattataaaataaatgcatgtgaattttagtacatattgaagttatatggaagaagatagccataatctgtaagaaagtaccgcagttaatattttctttagccaacttatattcaatgtattttttatggatcctttttcaaaggtagtatcagtaggcatagtcattttctgtatcttttcacctcacagttcatgaacatttcccatgtcattatagcacttttgtgttatataattgctgcattaatgttatagctgtattgatgtaataccagagttgttacgttcgggttatatgcaagtttatttcttagaaataaaactttgatggacttttc

SEQ ID NO: 449494 - DNA, 1949 bp, Homo sapiens
ggaacagtcatttccttgcagaataattggcttagggagaaagagacacagaaaacaaaacaagttcatcatgtacagcttggtctggctacaccccttttcagaaaccaggctgtgtaagagctgctggagtaggcacccatttaaagaaaaaatgaagaagcagcaataaagaagttgtaatcgttacctagacaaacagagaactggttttgacagtgtttctagagtgctttttattattttcctgacagttgtgttccaccatgattactttctccttcagcgaataggctaaatgaatatgaaacagaaaagcgtgtatcagcaaaccaaagcacttctgtgcaagaattttcttaagaaatggaggatgaaaagagagagcttattggaatggggcctctcaatacttctaggactgtgtattgctctgttttccagttccatgagaaatgtccagtttcctggaatggctcctcagaatctgggaagggtagataaatttaatagctcttctttaatggttgtgtatacaccaatatctaatttaacccagcagataatgaataaaacagcacttgctcctcttttgaaaggaacaagtgtcattggggcaccaaataaaacacacatggacgaaatacttctggaaaatttaccatatgctatgggaatcatctttaatgaaactttctcttataagttaatatttttccagggatataacagtccactttggaaagaagatttctcaggtgactttccatatcaaatatcattatggaatttttcatgttttcaacataaagaacagaggaggttgggcaacagagatgctttcaatgacacatgagaaaacagggaaagcccatttcattgctgaacttatttcaaggtcaatcgtatgttcctactacaggatgactgcaaaaattgtagagtcatccaacatatatgtgttgagcatgcagatgcatgtgtcaaaggacacatgagtaaccaagactgacaggccccagcctcaggtgagattccaggttagcagcaaagacagacattgaacaattaatgacaagtacaagaaaaagtgtttcatgggcacttagaccaggggttcctaatagtgggattagagaagtcctacctggggaaatgatgtttaaagggagaccagaatgaatagcaggtgtgaggtgctagaagcattgtgtttcagatagaagaaaggtaattgtgaagaccctgaggtgagaaaggacatctgttcctagatctggaagaagagcagtatagctgaacaaggaacatgaaaaggaatgtaatgggagagtgaagctgaagtcactcaagtgctacctcctgtggcatcttgtaaacctaggcaaggaatagccactgagtcactttaatcacggcaaaagtgtaattcggtttccaaaattaggggaacactccagatatagcccggggaatagattgccaagaggctatggagaatgtcaagaaacaaggagtccattatggctggagcagagtgtttgctttcatctcctttttattttctaagactttctaagcatgctgtggtctgcaagaataaaattgctttattaaaaactttcatttatttgcttcctttttctatgtagttaaaagtctactggtgggccagccatggtggctcacacctgtaatcccagcactttgagaggccgaggtgcacggatcacctgaggtcaggagttcgagaccagcctggccaacatggtgaaagcctgtctctactaaaaatacaaaaattagctagacaacgtggcctgtgcctataatcccagctttgggaggctgaggtaggagaatcacttgaacccaggaggtggaggttgcagtgagctgagatcgcaccactgcactccagcctgggcaacagagtgagacttcatctc

SEQ ID NO: 449495 - DNA, 2859 bp, Homo sapiens
aatctctccacggagtagagaaactcatcccaatccggaagagcccgaagaagaagatgaagatgttcaagctgaaagagtccaagcagcaaatgcactcactgctccaaacttggaggaggaaccagtcataactgcaagctgtttacacaaggaatattatgagacaaagaaaagttgcttttcaacaagaaagaagaaaatagccatcagaaatgtttccttttgtgttaaaaaaggtttgaacaattgttccttttattattattataatgttccttattctctagatttaagactacaaaggggacaaatttttattcattgagactggttcatatatcctggttaatgtgtaattataaaacttcttcacatgtcagcagataagtcttttctacttcaaaatcatgtcccaattcaaatggcaagaaacccagtcttggattaagaagaccctgattctctgtattaatgttgtaatacaggagatttttcaaggtgctaactaagcatttgtttcagaaatgttattttgaggtggccacggtggctcgtgcctctaatcctaatactttgagaggctgaggcgggaggcttgaggccaggatttcgagaccagcctgggcaacatagcaagactccatctctacaaaaaatttaaaaattagctgggtgtggtggtgcatgcatgtagttctggctacctgggagactgatgcaggaagatcgcttgagcccaggagatcaaggctgcagcaggcaatgattacaccaccacagtccagcctaggcaacagagcaaaactctgtctctgaaaaaaaaaaaaatcaaccttgaaaattcaaatattgatggtgactctttcttccaggtgaagttttgggattactaggacacaatggagctggtaaaagtacttccattaaaatgataactgggtgcacaaagccaactgcaggagtggtatgtgacatgtgaaggaaattttattttaaatattgatgacatctttctattattcctatcagtaaatcaaatatctttttaaaaaatagatgaaagaatttataaaatttctcttgcgtattcaaaaaatattgtagcttaatggccacttttatctcctttagtagaagggggattggagcaaaaaccaaaggtggatctgacattcattgtcttgtgcaggtggtgttacaaggcagcagagcatcagtaaggcaacagcatgacaacagcctcaagttcttggggtactgccctcaggagaactcactgtggcccaagcttacaatgaaagagcacttggagttgtatgcagctgtgaaaggactgggcaaagaagatgctgctctcagtatttcacgattggtggaagctcttaagctccaggaacaacttaaggctcctgtgaaaactctatcagagggaataaagagaaagctgtgctttgtgctgagcatcctggggaacccatcagtggtgcttctagatgagccgttcaccgggatggaccccgaggggcagcagcaaatgtggcagatacttcaggctaccgttaaaaacaaggagaggggcaccctcttgaccacccattacatgtcagaggctgaggctgtgtgtgaccgtatggccatgatggtgtcaggaacgctaaggtgtattggttccattcaacatctgaaaaacaagtttggtagagattatttactagaaataaaaatgaaagaacctacccaggtggaagctctccacacagagattttgaagcttttcccacaggctgcttggcaggaaagatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttaagttaacaaaagaaaacatttaataaacattcaataatgattacagttttcatttttaaaaatttaggatgaaggaaacaaggaaatatagggaaaagtagtagacaaaattaacaaaatcagacatgttattcatccccaacatgggtctattttgtgcttaaaaataatttaaaaatcatacaatattaggttggttttcggttattatcaataaagctaacactgagaacattttacaaataaaaatatgagttttttagcctgaacttcaaatgtatcagctatttttaaacattatttactcggattctaatttaatgtgacattgactataagaaggtctgataaactgatgaaatggcacagcataacatttaattataatgacattctgattataaaataaatgcatgtgaattttagtacatattgaagttatatggaagaagatagccataatctgtaagaaagtaccgcagttaatattttctttagccaacttatattcaatgtattttttatggatcctttttcaaaggtagtatcagtaggcatagtcattttctgtatcttttcacctcacagttcatgaacatttcccatgtcattatagcacttttgtgttatataattgctgcattaatgttatagctgtattgatgtaataccagagttgttacgttcgggttatatgcaagtttatttcttagaaataaaactttgatggacttttc

SEQ ID NO: 449496 - DNA, 3777 bp, Homo sapiens
aatctctccacggagtagagaaactcatcccaatccggaagagcccgaagaagaagatgaagatgttcaagctgaaagagtccaagcagcaaatgcactcactgctccaaacttggaggaggaaccagtcataactgcaagctgtttacacaaggaatattatgagacaaagaaaagttgcttttcaacaagaaagaagaaaatagccatcagaaatgtttccttttgtgttaaaaaaggtttgaacaattgttccttttattattattataatgttccttattctctagatttaagactacaaaggggacaaatttttattcattgagactggttcatatatcctggttaatgtgtaattataaaacttcttcacatgtcagcagataagtcttttctacttcaaaatcatgtcccaattcaaatggcaagaaacccagtcttggattaagaagaccctgattctctgtattaatgttgtaatacaggagatttttcaaggtgctaactaagcatttgtttcagaaatgttattttgaggtggccacggtggctcgtgcctctaatcctaatactttgagaggctgaggcgggaggcttgaggccaggatttcgagaccagcctgggcaacatagcaagactccatctctacaaaaaatttaaaaattagctgggtgtggtggtgcatgcatgtagttctggctacctgggagactgatgcaggaagatcgcttgagcccaggagatcaaggctgcagcaggcaatgattacaccaccacagtccagcctaggcaacagagcaaaactctgtctctgaaaaaaaaaaaaatcaaccttgaaaattcaaatattgatggtgactctttcttccaggtgaagttttgggattactaggacacaatggagctggtaaaagtacttccattaaaatgataactgggtgcacaaagccaactgcaggagtggtatgtgacatgtgaaggaaattttattttaaatattgatgacatctttctattattcctatcagtaaatcaaatatctttttaaaaaatagatgaaagaatttataaaatttctcttgcgtattcaaaaaatattgtagcttaatggccacttttatctcctttagtagaagggggattggagcaaaaaccaaaggtggatctgacattcattgtcttgtgcaggtggtgttacaaggcagcagagcatcagtaaggcaacagcatgacaacagcctcaagttcttggggtactgccctcaggagaactcactgtggcccaagcttacaatgaaagagcacttggagttgtatgcagctgtgaaaggactgggcaaagaagatgctgctctcagtatttcacgattggtggaagctcttaagctccaggaacaacttaaggctcctgtgaaaactctatcagagggaataaagagaaagctgtgctttgtgctgagcatcctggggaacccatcagtggtgcttctagatgagccgttcaccgggatggaccccgaggggcagcagcaaatgtggcagatacttcaggctaccgttaaaaacaaggagaggggcaccctcttgaccacccattacatgtcagaggctgaggctgtgtgtgaccgtatggccatgatggtgtcaggaacgctaaggtgtattggttccattcaacatctgaaaaacaagtttggtagagattatttactagaaataaaaatgaaagaacctacccaggtggaagctctccacacagagattttgaagcttttcccacaggctgcttggcaggaaagatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttgtgttccaccatgattactttctccttcagcgaataggctaaatgaatatgaaacagaaaagcgtgtatcagcaaaccaaagcacttctgtgcaagaattttcttaagaaatggaggatgaaaagagagagcttattggaatggggcctctcaatacttctaggactgtgtattgctctgttttccagttccatgagaaatgtccagtttcctggaatggctcctcagaatctgggaagggtagataaatttaatagctcttctttaatggttgtgtatacaccaatatctaatttaacccagcagataatgaataaaacagcacttgctcctcttttgaaaggaacaagtgtcattggggcaccaaataaaacacacatggacgaaatacttctggaaaatttaccatatgctatgggaatcatctttaatgaaactttctcttataagttaatatttttccagggatataacagtccactttggaaagaagatttctcaggtgactttccatatcaaatatcattatggaatttttcatgttttcaacataaagaacagaggaggttgggcaacagagatgctttcaatgacacatgagaaaacagggaaagcccatttcattgctgaacttatttcaaggtcaatcgtatgttcctactacaggatgactgcaaaaattgtagagtcatccaacatatatgtgttgagcatgcagatgcatgtgtcaaaggacacatgagtaaccaagactgacaggccccagcctcaggtgagattccaggttagcagcaaagacagacattgaacaattaatgacaagtacaagaaaaagtgtttcatgggcacttagaccaggggttcctaatagtgggattagagaagtcctacctggggaaatgatgtttaaagggagaccagaatgaatagcaggtgtgaggtgctagaagcattgtgtttcagatagaagaaaggtaattgtgaagaccctgaggtgagaaaggacatctgttcctagatctggaagaagagcagtatagctgaacaaggaacatgaaaaggaatgtaatgggagagtgaagctgaagtcactcaagtgctacctcctgtggcatcttgtaaacctaggcaaggaatagccactgagtcactttaatcacggcaaaagtgtaattcggtttccaaaattaggggaacactccagatatagcccggggaatagattgccaagaggctatggagaatgtcaagaaacaaggagtccattatggctggagcagagtgtttgctttcatctcctttttattttctaagactttctaagcatgctgtggtctgcaagaataaaattgctttattaaaaactttcatttatttgcttcctttttctatgtagttaaaagtctactggtgggccagccatggtggctcacacctgtaatcccagcactttgagaggccgaggtgcacggatcacctgaggtcaggagttcgagaccagcctggccaacatggtgaaagcctgtctctactaaaaatacaaaaattagctagacaacgtggcctgtgcctataatcccagctttgggaggctgaggtaggagaatcacttgaacccaggaggtggaggttgcagtgagctgagatcgcaccactgcactccagcctgggcaacagagtgagacttcatctc

SEQ ID NO: 449497 - DNA, 1469 bp, Homo sapiens
cggggtttccctgtgcacccatggctgggtgccgacgggctgttccttgcattgcagctgtgctttgtgctgagcatcctggggaacccatcagtggtgcttctagatgagccgttcaccgggatggaccccgaggggcagcagcaaatgtggcagatacttcaggctaccgttaaaaacaaggagaggggcaccctcttgaccacccattacatgtcagaggctgaggctgtgtgtgaccgtatggccatgatggtgtcaggaacgctaaggtgtattggttccattcaacatctgaaaaacaagtttggtagagattatttactagaaataaaaatgaaagaacctacccaggtggaagctctccacacagagattttgaagcttttcccacaggctgcttggcaggaaagatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttaagttaacaaaagaaaacatttaataaacattcaataatgattacagttttcatttttaaaaatttaggatgaaggaaacaaggaaatatagggaaaagtagtagacaaaattaacaaaatcagacatgttattcatccccaacatgggtctattttgtgcttaaaaataatttaaaaatcatacaatattaggttggttttcggttattatcaataaagctaacactgagaacattttacaaataaaaatatgagttttttagcctgaacttcaaatgtatcagctatttttaaacattatttactcggattctaatttaatgtgacattgactataagaaggtctgataaactgatgaaatggcacagcataacatttaattataatgacattctgattataaaataaatgcatgtgaattttagtacatattgaagttatatggaagaagatagccataatctgtaagaaagtaccgcagttaatattttctttagccaacttatattcaatgtattttttatggatcctttttcaaaggtagtatcagtaggcatagtcattttctgtatcttttcacctcacagttcatgaacatttcccatgtcattatagcacttttgtgttatataattgctgcattaatgttatagctgtattgatgtaataccagagttgttacgttcgggttatatgcaagtttatttcttagaaataaaactttgatggacttttc

SEQ ID NO: 449498 - DNA, 1440 bp, Homo sapiens
aatctctccacggagtagagaaactcatcccaatccggaagagcccgaagaagaagatgaagatgttcaagctgaaagagtccaagcagcaaatgcactcactgctccaaacttggaggaggaaccagtcataactgcaagctgtttacacaaggaatattatgagacaaagaaaagttgcttttcaacaagaaagaagaaaatagccatcagaaatgtttccttttgtgttaaaaaaggtttgaacaattgttccttttattattattataatgttccttattctctagatttaagactacaaaggggacaaatttttattcattgagactggttcatatatcctggttaatgtgtaattataaaacttcttcacatgtcagcagataagtcttttctacttcaaaatcatgtcccaattcaaatggcaagaaacccagtcttggattaagaagaccctgattctctgtattaatgttgtaatacaggagatttttcaaggtgctaactaagcatttgtttcagaaatgttattttgaggtggccacggtggctcgtgcctctaatcctaatactttgagaggctgaggcgggaggcttgaggccaggatttcgagaccagcctgggcaacatagcaagactccatctctacaaaaaatttaaaaattagctgggtgtggtggtgcatgcatgtagttctggctacctgggagactgatgcaggaagatcgcttgagcccaggagatcaaggctgcagcaggcaatgattacaccaccacagtccagcctaggcaacagagcaaaactctgtctctgaaaaaaaaaaaaatcaaccttgaaaattcaaatattgatggtgactctttcttccaggtgaagttttgggattactaggacacaatggagctggtaaaagtacttccattaaaatgataactgggtgcacaaagccaactgcaggagtggtatgtgacatgtgaaggaaattttattttaaatattgatgacatctttctattattcctatcagtaaatcaaatatctttttaaaaaatagatgaaagaatttataaaatttctcttgcgtattcaaaaaatattgtagcttaatggccacttttatctcctttagtagaagggggattggagcaaaaaccaaaggtggatctgacattcattgtcttgtgcaggtggtgttacaaggcagcagagcatcagtaaggcaacagcatgacaacagcctcaagttcttggggtactgccctcaggagaactcactgtggcccaagcttacaatgaaagagcacttggagttgtatgcagctgtgaaaggactgggcaaagaagatgctgctctcagtatttcacggtacagagagaagtctcacaatttgtagcaggaggaaggggaaaatatgtcatttcttcattatatatt

SEQ ID NO: 449499 - DNA, 2149 bp, Homo sapiens
aatctctccacggagtagagaaactcatcccaatccggaagagcccgaagaagaagatgaagatgttcaagctgaaagagtccaagcagcaaatgcactcactgctccaaacttggaggaggaaccagtcataactgcaagctgtttacacaaggaatattatgagacaaagaaaagttgcttttcaacaagaaagaagaaaatagccatcagaaatgtttccttttgtgttaaaaaaggtttgaacaattgttccttttattattattataatgttccttattctctagatttaagactacaaaggggacaaatttttattcattgagactggttcatatatcctggttaatgtgtaattataaaacttcttcacatgtcagcagataagtcttttctacttcaaaatcatgtcccaattcaaatggcaagaaacccagtcttggattaagaagaccctgattctctgtattaatgttgtaatacaggagatttttcaaggtgctaactaagcatttgtttcagaaatgttattttgaggtggccacggtggctcgtgcctctaatcctaatactttgagaggctgaggcgggaggcttgaggccaggatttcgagaccagcctgggcaacatagcaagactccatctctacaaaaaatttaaaaattagctgggtgtggtggtgcatgcatgtagttctggctacctgggagactgatgcaggaagatcgcttgagcccaggagatcaaggctgcagcaggcaatgattacaccaccacagtccagcctaggcaacagagcaaaactctgtctctgaaaaaaaaaaaaatcaaccttgaaaattcaaatattgatggtgactctttcttccaggtgaagttttgggattactaggacacaatggagctggtaaaagtacttccattaaaatgataactgggtgcacaaagccaactgcaggagtggtatgtgacatgtgaaggaaattttattttaaatattgatgacatctttctattattcctatcagtaaatcaaatatctttttaaaaaatagatgaaagaatttataaaatttctcttgcgtattcaaaaaatattgtagcttaatggccacttttatctcctttagtagaagggggattggagcaaaaaccaaaggtggatctgacattcattgtcttgtgcaggtggtgttacaaggcagcagagcatcagtaaggcaacagcatgacaacagcctcaagttcttggggtactgccctcaggagaactcactgtggcccaagcttacaatgaaagagcacttggagttgtatgcagctgtgaaaggactgggcaaagaagatgctgctctcagtatttcacgattggtggaagctcttaagctccaggaacaacttaaggctcctgtgaaaactctatcagagggaataaagagaaagctgtgctttgtgctgagcatcctggggaacccatcagtggtgcttctagatgagccgttcaccgggatggaccccgaggggcagcagcaaatgtggcagatacttcaggctaccgttaaaaacaaggagaggggcaccctcttgaccacccattacatgtcagaggctgaggctgtgtgtgaccgtatggccatgatggtgtcaggaacgctaaggtgtattggttccattcaacatctgaaaaacaagtttggtagagattatttactagaaataaaaatgaaagaacctacccaggtggaagctctccacacagagattttgaagcttttcccacaggctgcttggcaggaaagatattcctctttaatggcgtataagttacctgtggaggatgtccaccctctatctcgggcctttttcaagttagaggcgatgaaacagaccttcaacctggaggaatacagcctctctcaggctaccttggagcagtgacaggaggaccactgccacagaaaccaccctaaagtcagaagcagcggtaagaagataggcctgatggaagcagagctgacatgcagttgctgactttcacatgcttccaacaagcagattttgcagcagagcaatatgaaacattgattggatgaatacagaagcaaatgaatcagaaaatttagcaggattgtgttagattgggca

SEQ ID NO: 449500 - DNA, 1130 bp, Homo sapiens
ctttctccctcctttctcctccccggatcctccactgcgtcgcccggtctcatcgggcagccgggcgcctagccatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttaagttaacaaaagaaaacatttaataaacattcaataatgattacagttttcatttttaaaaatttaggatgaaggaaacaaggaaatatagggaaaagtagtagacaaaattaacaaaatcagacatgttattcatccccaacatgggtctattttgtgcttaaaaataatttaaaaatcatacaatattaggttggttttcggttattatcaataaagctaacactgagaacattttacaaataaaaatatgagttttttagcctgaacttcaaatgtatcagctatttttaaacattatttactcggattctaatttaatgtgacattgactataagaaggtctgataaactgatgaaatggcacagcataacatttaattataatgacattctgattataaaataaatgcatgtgaattttagtacatattgaagttatatggaagaagatagccataatctgtaagaaagtaccgcagttaatattttctttagccaacttatattcaatgtattttttatggatcctttttcaaaggtagtatcagtaggcatagtcattttctgtatcttttcacctcacagttcatgaacatttcccatgtcattatagcacttttgtgttatataattgctgcattaatgttatagctgtattgatgtaataccagagttgttacgttcgggttatatgcaagtttatttcttagaaataaaactttgatggacttttc

SEQ ID NO: 449501 - DNA, 1998 bp, Homo sapiens
aatctctccacggagtagagaaactcatcccaatccggaagagcccgaagaagaagatgaagatgttcaagctgaaagagtccaagcagcaaatgcactcactgctccaaacttggaggaggaaccagtcataactgcaagctgtttacacaaggaatattatgagacaaagaaaagttgcttttcaacaagaaagaagaaaatagccatcagaaatgtttccttttgtgttaaaaaaggtgaagttttgggattactaggacacaatggagctggtaaaagtacttccattaaaatgataactgggtgcacaaagccaactgcaggagtggtggtgttacaaggcagcagagcatcagtaaggcaacagcatgacaacagcctcaagttcttggggtactgccctcaggagaactcactgtggcccaagcttacaatgaaagagcacttggagttgtatgcagctgtgaaaggactgggcaaagaagatgctgctctcagtatttcacgattggtggaagctcttaagctccaggaacaacttaaggctcctgtgaaaactctatcagagggaataaagagaaagctgtgctttgtgctgagcatcctggggaacccatcagtggtgcttctagatgagccgttcaccgggatggaccccgaggggcagcagcaaatgtggcagatacttcaggctaccgttaaaaacaaggagaggggcaccctcttgaccacccattacatgtcagaggctgaggctgtgtgtgaccgtatggccatgatggtgtcaggaacgctaaggtgtattggttccattcaacatctgaaaaacaagtttggtagagattatttactagaaataaaaatgaaagaacctacccaggtggaagctctccacacagagattttgaagcttttcccacaggctgcttggcaggaaagatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttaagttaacaaaagaaaacatttaataaacattcaataatgattacagttttcatttttaaaaatttaggatgaaggaaacaaggaaatatagggaaaagtagtagacaaaattaacaaaatcagacatgttattcatccccaacatgggtctattttgtgcttaaaaataatttaaaaatcatacaatattaggttggttttcggttattatcaataaagctaacactgagaacattttacaaataaaaatatgagttttttagcctgaacttcaaatgtatcagctatttttaaacattatttactcggattctaatttaatgtgacattgactataagaaggtctgataaactgatgaaatggcacagcataacatttaattataatgacattctgattataaaataaatgcatgtgaattttagtacatattgaagttatatggaagaagatagccataatctgtaagaaagtaccgcagttaatattttctttagccaacttatattcaatgtattttttatggatcctttttcaaaggtagtatcagtaggcatagtcattttctgtatcttttcacctcacagttcatgaacatttcccatgtcattatagcacttttgtgttatataattgctgcattaatgttatagctgtattgatgtaataccagagttgttacgttcgggttatatgcaagtttatttcttagaaataaaactttgatggacttttc

SEQ ID NO: 449502 - DNA, 1891 bp, Homo sapiens
gttggaggatgaaagtacggagtgatccatcggctaagtgtcttgtcacaatgctgacactcaaactgctggagtaggcacccatttaaagaaaaaatgaagaagcagcaataaagaagttgtaatcgttacctagacaaacagagaactggttttgacagtgtttctagagtgctttttattattttcctgacagttgtgttccaccatgattactttctccttcagcgaataggctaaatgaatatgaaacagaaaagcgtgtatcagcaaaccaaagcacttctgtgcaagaattttcttaagaaatggaggatgaaaagagagagcttattggaatggggcctctcaatacttctaggactgtgtattgctctgttttccagttccatgagaaatgtccagtttcctggaatggctcctcagaatctgggaagggtagataaatttaatagctcttctttaatggttgtgtatacaccaatatctaatttaacccagcagataatgaataaaacagcacttgctcctcttttgaaaggaacaagtgtcattggggcaccaaataaaacacacatggacgaaatacttctggaaaatttaccatatgctatgggaatcatctttaatgaaactttctcttataagttaatatttttccagggatataacagtccactttggaaagaagatttctcaggtgactttccatatcaaatatcattatggaatttttcatgttttcaacataaagaacagaggaggttgggcaacagagatgctttcaatgacacatgagaaaacagggaaagcccatttcattgctgaacttatttcaaggtcaatcgtatgttcctactacaggatgactgcaaaaattgtagagtcatccaacatatatgtgttgagcatgcagatgcatgtgtcaaaggacacatgagtaaccaagactgacaggccccagcctcaggtgagattccaggttagcagcaaagacagacattgaacaattaatgacaagtacaagaaaaagtgtttcatgggcacttagaccaggggttcctaatagtgggattagagaagtcctacctggggaaatgatgtttaaagggagaccagaatgaatagcaggtgtgaggtgctagaagcattgtgtttcagatagaagaaaggtaattgtgaagaccctgaggtgagaaaggacatctgttcctagatctggaagaagagcagtatagctgaacaaggaacatgaaaaggaatgtaatgggagagtgaagctgaagtcactcaagtgctacctcctgtggcatcttgtaaacctaggcaaggaatagccactgagtcactttaatcacggcaaaagtgtaattcggtttccaaaattaggggaacactccagatatagcccggggaatagattgccaagaggctatggagaatgtcaagaaacaaggagtccattatggctggagcagagtgtttgctttcatctcctttttattttctaagactttctaagcatgctgtggtctgcaagaataaaattgctttattaaaaactttcatttatttgcttcctttttctatgtagttaaaagtctactggtgggccagccatggtggctcacacctgtaatcccagcactttgagaggccgaggtgcacggatcacctgaggtcaggagttcgagaccagcctggccaacatggtgaaagcctgtctctactaaaaatacaaaaattagctagacaacgtggcctgtgcctataatcccagctttgggaggctgaggtaggagaatcacttgaacccaggaggtggaggttgcagtgagctgagatcgcaccactgcactccagcctgggcaacagagtgagacttcatctc

SEQ ID NO: 449503 - DNA, 2322 bp, Homo sapiens
aatctctccacggagtagagaaactcatcccaatccggaagagcccgaagaagaagatgaagatgttcaagctgaaagagtccaagcagcaaatgcactcactgctccaaacttggaggaggaaccagtcataactgcaagctgtttacacaaggaatattatgagacaaagaaaagttgcttttcaacaagaaagaagaaaatagccatcagaaatgtttccttttgtgttaaaaaaggtttgaacaattgttccttttattattattataatgttccttattctctagatttaagactacaaaggggacaaatttttattcattgagactggttcatatatcctggttaatgtgtaattataaaacttcttcacatgtcagcagataagtcttttctacttcaaaatcatgtcccaattcaaatggcaagaaacccagtcttggattaagaagaccctgattctctgtattaatgttgtaatacaggagatttttcaaggtgctaactaagcatttgtttcagaaatgttattttgaggtggccacggtggctcgtgcctctaatcctaatactttgagaggctgaggcgggaggcttgaggccaggatttcgagaccagcctgggcaacatagcaagactccatctctacaaaaaatttaaaaattagctgggtgtggtggtgcatgcatgtagttctggctacctgggagactgatgcaggaagatcgcttgagcccaggagatcaaggctgcagcaggcaatgattacaccaccacagtccagcctaggcaacagagcaaaactctgtctctgaaaaaaaaaaaaatcaaccttgaaaattcaaatattgatggtgactctttcttccaggtgaagttttgggattactaggacacaatggagctggtaaaagtacttccattaaaatgataactgggtgcacaaagccaactgcaggagtggtatgtgacatgtgaaggaaattttattttaaatattgatgacatctttctattattcctatcagtaaatcaaatatctttttaaaaaatagatgaaagaatttataaaatttctcttgcgtattcaaaaaatattgtagcttaatggccacttttatctcctttagtagaagggggattggagcaaaaaccaaaggtggatctgacattcattgtcttgtgcaggtggtgttacaaggcagcagagcatcagtaaggcaacagcatgacaacagcctcaagttcttggggtactgccctcaggagaactcactgtggcccaagcttacaatgaaagagcacttggagttgtatgcagctgtgaaaggactgggcaaagaagatgctgctctcagtatttcacgattggtggaagctcttaagctccaggaacaacttaaggctcctgtgaaaactctatcagagggaataaagagaaagctgtgctttgtgctgagcatcctggggaacccatcagtggtgcttctagatgagccgttcaccgggatggaccccgaggggcagcagcaaatgtggcagatacttcaggctaccgttaaaaacaaggagaggggcaccctcttgaccacccattacatgtcagaggctgaggctgtgtgtgaccgtatggccatgatggtgtcaggaacgctaaggtgtattggttccattcaacatctgaaaaacaagtttggtagagattatttactagaaataaaaatgaaagaacctacccaggtggaagctctccacacagagattttgaagcttttcccacaggctgcttggcaggaaagatattcctctttaatggcgtataagttacctgtggaggatgtccaccctctatctcgggcctttttcaagttagaggcgatgaaacagaccttcaacctggaggaatacagcctctctcaggctaccttggagcagaagcagtgtgaggcctcactggatgcagatattggcaccacgcttcttgtacaacctgtggtttcagaatcccaactgaaaaagtcagcctaaaagtgtcctgtgaaacacctgggaagataggacgtcaggcaagcaacaacttcaatgcaaaatgtgtcttgttccaaaagtgacaggaggaccactgccacagaaaccaccctaaagtcagaagcagcggtaagaagataggcctgatggaagcagagctgacatgcagttgctgactttcacatgcttccaacaagcagattttgcagcagagcaatatgaaacattgattggatgaatacagaagcaaatgaatcagaaaatttagcaggattgtgttagattgggca

SEQ ID NO: 449504 - DNA, 1390 bp, Homo sapiens
ggcgcacttccgcccgggcgcattgtagccccgcggacagctgggccagggtgcgggcctgcgcctccctcggctcctggcgcgggcctcggggagaggggtggaagatgtctatggatgtgacattcctggggacgggtgcagcatacccatctccaacccggggtgcctctgctgtggtccttcggtgtgaaggcgagtgctggctctttgactgtggggagggaacacagacacagcttatgaaaagccaacttaaagcagggagaattaccaagatcttcatcacacaccttcatggagaccatttctttggccttcctgggctcctctgcacaatcagcctgcagagtggctccatggtgtccaaacagcctattgaaatctatggccctgtagggcttcgggactttatctggcgaaccatggaactctctcacacggagctggtcttccattatgtggttcatgaactggttcctacagcagatcaatgtcctgcagaagaactaaaagaatttgcgcatgtgaatagagcagacagtcctcccaaagaggaacaaggaagaactatcctgttagactcagaagaaaactcataccttctgtttgatgatgaacaatttgttgtaaaagcatttcgcctctttcacagaattccctcatttgggttttcagtcgtggaaaagaaacgcccaggtaaactcaatgcacagaaacttaaagaccttggtgttccaccaggtcctgcctatgggaagctgaaaaatggaatttctgttgttctggaaaatggggttacaatttctccccaagatgtcttaaaaaagcctattgttggaagaaaaatctgcatattgggtgactgctctggggttgtgggtgatggaggagtaaaactgtgctttgaagcagacctgttgatccacgaagcaaccctggatgatgcccagatggacaaagcaaaggagcatggccacagcacaccacagatggcagcaacatttgcaaagttgtgccgtgcaaagaggctggttctgactcacttcagtcagaggtacaaaccagttgccttggccagagaaggagaaacagatggcattgcagaactaaaaaagcaagctgaatcagtgttagatctccaagaagtgactctagcagaagattttatggtgataagcattccaatcaagaaatgaaaccagtgttcctgagtgcacactgacatgtctgtgaatatgttactgaacctatagtccagtttttttatttcttgttttagtctgaaattatttgggccctaataatcctaaaaagaatggagctgcattgatgaattggctcagtatttaaagggagcaaactttttgataataaatctttttaagag

SEQ ID NO: 449505 - DNA, 2180 bp, Homo sapiens
ggcgcacttccgcccgggcgcattgtagccccgcggacagctgggccagggtgcgggcctgcgcctccctcggctcctggcgcgggcctcggggagaggggtggaagatgtctatggatgtgacattcctggggacgggtgcagcatacccatctccaacccggggtgcctctgctgtggtccttcggtgtgaaggcgagtgctggctctttgactgtggggagggaacacagacacagcttcatggagaccatttctttggccttcctgggctcctctgcacaatcagcctgcagagtggctccatggtgtccaaacagcctattgaaatctatggccctgtagggcttcgggactttatctggcgaaccatggaactctctcacacggagctggtcttccattatgtggttcatgaactggttcctacagcagatcaatgtcctgcagaagaactaaaagaatttgcgcatgtgaatagagcagacagtcctcccaaagaggaacaaggaagaactatcctgttagactcagaagaaaactcataccttctgtttgatgatgaacaatttgttgtaaaagcatttcgcctctttcacagaattccctcatttgggttttcagtcgtggaaaagaaacgcccaggtaaactcaatgcacagaaacttaaagaccttggtgttccaccaggtcctgcctatgggaagctgaaaaatggaatttctgttgttctggaaaatggggttacaatttctccccaagatgtcttaaaaaagcctattgttggaagaaaaatctgcatattgggtgactgctctggggttgtgggtgatggaggagtaaaactgtgctttgaagcagacctgttgatccacgaagcaaccctggatgatgcccagatggacaaagcaaaggagcatggccacagcacaccacagatggcagcaacatttgcaaagttgtgccgtgcaaagaggctggttctgactcacttcagtcagaggtacaaaccagttgccttggccagagaaggagaaacagatggcattgcagaactaaaaaagcaagctgaatcagtgttagatctccaagaagtgactctagcagaagattttatggtgataagcattccaatcaagaaatgaaaccagtgttcctgagtgcacactgacatgtctgtgaatatgttactgaacctatagtccagtttttttatttcttgttttagtctgaaattatttgggccctaataatcctaaaaagaatggagctgcattgatgaattggctcagtatttaaagggagcaaactttttgataataaatctttttaagagaaaaaaaacccagcatcctttttgaagtccagatttgtcaaaatgatagactattcagttatacatcttattttgtgctactaccacagatagccaatattccatgcagtcctgggcttagcttctgcccagctttattgctgctattggcaaagagcacaggactcagccctcgtggctaaaaatggtattttggcagtttgtattgaatctgtttgtgttattaacagaagagggagaaatgtcatgagacgttggacaggcaggattgatgatagcatgaccatagctttgctggaatactgaatgcagggtttggctaggtgtttattttaacattttattaaactttctatttgggtcttaacccatggttctcagctggggtgacactgctcctctagaagcaggtttgaaattatgggtatgttttcttgtcacagtgactgagtacggtggtggtagtggtggtactactactactggtatttagtcagcagggataagggatgttagctgtcctgcaaagttttggtcagtcatatacaataaagaatcatctcaccccgaaatgcaaattgcaggcccattgagatacacagcaagttagtttatactcttgatgtgaatatagtttaccaaaattagtgacataatgagtggaattactaggtaagtcaaatcctaaagagtgaatgtgttagaattgcagtgtcataccaaataacattcaaaagaaatgagccatcaagtgaagcttatgaacctggaggtaaaaaatgcttatctgttaaactgaggtttcattgacgtgtccctattaataaacgttatttgccccaca

SEQ ID NO: 449506 - DNA, 2234 bp, Homo sapiens
ggcgcacttccgcccgggcgcattgtagccccgcggacagctgggccagggtgcgggcctgcgcctccctcggctcctggcgcgggcctcggggagaggggtggaagatgtctatggatgtgacattcctggggacgggtgcagcatacccatctccaacccggggtgcctctgctgtggtccttcggtgtgaaggcgagtgctggctctttgactgtggggagggaacacagacacagcttatgaaaagccaacttaaagcagggagaattaccaagatcttcatcacacaccttcatggagaccatttctttggccttcctgggctcctctgcacaatcagcctgcagagtggctccatggtgtccaaacagcctattgaaatctatggccctgtagggcttcgggactttatctggcgaaccatggaactctctcacacggagctggtcttccattatgtggttcatgaactggttcctacagcagatcaatgtcctgcagaagaactaaaagaatttgcgcatgtgaatagagcagacagtcctcccaaagaggaacaaggaagaactatcctgttagactcagaagaaaactcataccttctgtttgatgatgaacaatttgttgtaaaagcatttcgcctctttcacagaattccctcatttgggttttcagtcgtggaaaagaaacgcccaggtaaactcaatgcacagaaacttaaagaccttggtgttccaccaggtcctgcctatgggaagctgaaaaatggaatttctgttgttctggaaaatggggttacaatttctccccaagatgtcttaaaaaagcctattgttggaagaaaaatctgcatattgggtgactgctctggggttgtgggtgatggaggagtaaaactgtgctttgaagcagacctgttgatccacgaagcaaccctggatgatgcccagatggacaaagcaaaggagcatggccacagcacaccacagatggcagcaacatttgcaaagttgtgccgtgcaaagaggctggttctgactcacttcagtcagaggtacaaaccagttgccttggccagagaaggagaaacagatggcattgcagaactaaaaaagcaagctgaatcagtgttagatctccaagaagtgactctagcagaagattttatggtgataagcattccaatcaagaaatgaaaccagtgttcctgagtgcacactgacatgtctgtgaatatgttactgaacctatagtccagtttttttatttcttgttttagtctgaaattatttgggccctaataatcctaaaaagaatggagctgcattgatgaattggctcagtatttaaagggagcaaactttttgataataaatctttttaagagaaaaaaaacccagcatcctttttgaagtccagatttgtcaaaatgatagactattcagttatacatcttattttgtgctactaccacagatagccaatattccatgcagtcctgggcttagcttctgcccagctttattgctgctattggcaaagagcacaggactcagccctcgtggctaaaaatggtattttggcagtttgtattgaatctgtttgtgttattaacagaagagggagaaatgtcatgagacgttggacaggcaggattgatgatagcatgaccatagctttgctggaatactgaatgcagggtttggctaggtgtttattttaacattttattaaactttctatttgggtcttaacccatggttctcagctggggtgacactgctcctctagaagcaggtttgaaattatgggtatgttttcttgtcacagtgactgagtacggtggtggtagtggtggtactactactactggtatttagtcagcagggataagggatgttagctgtcctgcaaagttttggtcagtcatatacaataaagaatcatctcaccccgaaatgcaaattgcaggcccattgagatacacagcaagttagtttatactcttgatgtgaatatagtttaccaaaattagtgacataatgagtggaattactaggtaagtcaaatcctaaagagtgaatgtgttagaattgcagtgtcataccaaataacattcaaaagaaatgagccatcaagtgaagcttatgaacctggaggtaaaaaatgcttatctgttaaactgaggtttcattgacgtgtccctattaataaacgttatttgccccaca

SEQ ID NO: 449507 - DNA, 1843 bp, Homo sapiens
ggcgcacttccgcccgggcgcattgtagccccgcggacagctgggccagggtgcgggcctgcgcctccctcggctcctggcgcgggcctcggggagaggggtggaagatgtctatggatgtgacattcctggggacgggtgcagcatacccatctccaacccggggtgcctctgctgtggtccttcggtgtgaaggcgagtgctggctctttgactgtggggagggaacacagacacagcttatgaaaagccaacttaaagcagaattccctcatttgggttttcagtcgtggaaaagaaacgcccaggtaaactcaatgcacagaaacttaaagaccttggtgttccaccaggtcctgcctatgggaagctgaaaaatggaatttctgttgttctggaaaatggggttacaatttctccccaagatgtcttaaaaaagcctattgttggaagaaaaatctgcatattgggtgactgctctggggttgtgggtgatggaggagtaaaactgtgctttgaagcagacctgttgatccacgaagcaaccctggatgatgcccagatggacaaagcaaaggagcatggccacagcacaccacagatggcagcaacatttgcaaagttgtgccgtgcaaagaggctggttctgactcacttcagtcagaggtacaaaccagttgccttggccagagaaggagaaacagatggcattgcagaactaaaaaagcaagctgaatcagtgttagatctccaagaagtgactctagcagaagattttatggtgataagcattccaatcaagaaatgaaaccagtgttcctgagtgcacactgacatgtctgtgaatatgttactgaacctatagtccagtttttttatttcttgttttagtctgaaattatttgggccctaataatcctaaaaagaatggagctgcattgatgaattggctcagtatttaaagggagcaaactttttgataataaatctttttaagagaaaaaaaacccagcatcctttttgaagtccagatttgtcaaaatgatagactattcagttatacatcttattttgtgctactaccacagatagccaatattccatgcagtcctgggcttagcttctgcccagctttattgctgctattggcaaagagcacaggactcagccctcgtggctaaaaatggtattttggcagtttgtattgaatctgtttgtgttattaacagaagagggagaaatgtcatgagacgttggacaggcaggattgatgatagcatgaccatagctttgctggaatactgaatgcagggtttggctaggtgtttattttaacattttattaaactttctatttgggtcttaacccatggttctcagctggggtgacactgctcctctagaagcaggtttgaaattatgggtatgttttcttgtcacagtgactgagtacggtggtggtagtggtggtactactactactggtatttagtcagcagggataagggatgttagctgtcctgcaaagttttggtcagtcatatacaataaagaatcatctcaccccgaaatgcaaattgcaggcccattgagatacacagcaagttagtttatactcttgatgtgaatatagtttaccaaaattagtgacataatgagtggaattactaggtaagtcaaatcctaaagagtgaatgtgttagaattgcagtgtcataccaaataacattcaaaagaaatgagccatcaagtgaagcttatgaacctggaggtaaaaaatgcttatctgttaaactgaggtttcattgacgtgtccctattaataaacgttatttgccccaca

SEQ ID NO: 449508 - DNA, 1010 bp, Homo sapiens
agacaattttcagcaggaagaagtagaaaggataaaatggatcctgcaccacgggaacctcacagcacctcacggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatga

SEQ ID NO: 449509 - DNA, 728 bp, Homo sapiens
ggctcagcgccttcatgctggggagtgagtccagaggtgccccaaagagaaagaaaaccaaaagaagtcccgctacagtgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatga

SEQ ID NO: 449510 - DNA, 968 bp, Homo sapiens
  misc_feature (5)..(5): n is a, c, g, or t
  misc_feature (7)..(7): n is a, c, g, or t
aactnanggctaggtacgaggctgggtgtggggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatga

SEQ ID NO: 449511 - DNA, 1035 bp, Homo sapiens
  misc_feature (907)..(907): n is a, c, g, or t
  misc_feature (915)..(915): n is a, c, g, or t
  misc_feature (918)..(918): n is a, c, g, or t
  misc_feature (922)..(923): n is a, c, g, or t
agacaattttcagcaggaagaagtagaaaggataaaatggatcctgcaccacgggaacctcacagcacctcacggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttanggagggcntcngacnngcagttttacttttaaagaccttggtataagctttacctgggttttggcaaaaaaaacggctttgggggaaggaggcggattcccctgagatgccttattaaattaaaaaag

SEQ ID NO: 449512 - DNA, 1907 bp, Homo sapiens
gcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccaggtaagcctcgaagtcgggacagggctgaacacccaggcaaggatgctgcgggaccctcggagctcccgattgcctcgcgtaactcttccctcttttcctctaatcagacagccgagctcgctccggaacttgtcatctccaacgacaaaaggagcttttgccactgactcggccgtgtcctgacacctccaggtgagtatctcctctcttggagagggaggtttaaacggcaagtcctggagttggcagacgttttgaaaaattgccactcactcggtttagggaaactgaggccagagagggacaagtgacttgcccatggttgcatcaaatgaatggcagagtcagtttccatgtgatgtgcatttaagccttaaatgcgcctgggccctgccctcccgcagtggccgagggtctggcaaagtagacatgggtccgactaaatacaagtctttctgttccatgttgtatagggagctgtcttcggcagccccctcccagctagtgtcaattccaagtaggaggggtagcgcaagctccgcctgtggtctttggcgccaactgggtgggggcagcgtggggcgcggagttatcagctggaggtacagaccaagtttcctccctggcgccggccagtctgcggacggcccccgcctcggcacgctcggcggaaactgactgctccttggtcttctttcctcccccgcccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatga

SEQ ID NO: 449513 - DNA, 1853 bp, Homo sapiens
gcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccaggtaagcctcgaagtcgggacagggctgaacacccaggcaaggatgctgcgggaccctcggagctcccgattgcctcgcgtaactcttccctcttttcctctaatcagacagccgagctcgctccggaacttgtcatctccaacgacaaaaggagcttttgccactgactcggccgtgtcctgacacctccaggtgagtatctcctctcttggagagggaggtttaaacggcaagtcctggagttggcagacgttttgattgcccatggttgcatcaaatgaatggcagagtcagtttccatgtgatgtgcatttaagccttaaatgcgcctgggccctgccctcccgcagtggccgagggtctggcaaagtagacatgggtccgactaaatacaagtctttctgttccatgttgtatagggagctgtcttcggcagccccctcccagctagtgtcaattccaagtaggaggggtagcgcaagctccgcctgtggtctttggcgccaactgggtgggggcagcgtggggcgcggagttatcagctggaggtacagaccaagtttcctccctggcgccggccagtctgcggacggcccccgcctcggcacgctcggcggaaactgactgctccttggtcttctttcctcccccgcccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatga

SEQ ID NO: 449514 - DNA, 1417 bp, Homo sapiens
gcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccaggtaagcctcgaagtcgggacagggctgaacacccaggcaaggatgctgcgggaccctcggagctcccgattgcctcgcgtaactcttccctcttttcctctaatcagacagccgagctcgctccggaacttgtcatctccaacgacaaaaggagcttttgccactgactcggccgtgtcctgacacctccaggtgagtatctcctctcttggagagggaggtttaaacggcaagtcctggagttggcagacgttttgaaaaattgccactcactcggtttagggaaactgaggccagagagggacaagtgacttgcccatggttgcatcaaatgaatggcagagtcagtttccatgtgatgtgcatttaagccttaaatgcgcctgggccctgccctcccgcagtggccgagggtctggcaaagtagacatgggtccgactaaatacaagtctttctgttccatgttgtatagggagctgtcttcggcagccccctcccagctagtgtcaattccaagtaggaggggtagcgcaagctccgcctgtggtctttggcgccaactgggtgggggcagcgtggggcgcggagttatcagctggaggtacagaccaagtttcctccctggcgccggccagtctgcggacggcccccgcctcggcacgctcggcggaaactgactgctccttgtcgtggcgattgggatcctaagagtcgccta

SEQ ID NO: 449515 - DNA, 1281 bp, Homo sapiens
gcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatga

SEQ ID NO: 449516 - DNA, 1095 bp, Homo sapiens
gcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtgagtgtgaggtgtgtctcattgcaggggaacggctcggccctgaaaggtgtgccgt

SEQ ID NO: 449517 - DNA, 2063 bp, Homo sapiens
gcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatgaaaaaaaaaaacacagaaaaaaacacgaaagaaagaaacagagaaacaaaaacacacgagcagagacgaagacagccagaacacacacgcgagtagaccacaagaccaaaaaagaaaagcaaacggatcaggagcggtaaaaacagaaagacaagcagcagcggagggatacagaagcgagcggggatcgcggaagcgaccagcagaagaccaggccgacggagtcgagacacaaggggcgcagtgagacgggagcgagggcagaaggcacgcggcacgtcgacagcactgcgtaggcgtaggagaaggtcaaactgaaagaaaacagtacgagcagcacggggcgacaaggaaagaaccgagaagagaagcgtagacaagcagggaaggccaaagcagacgagcaggagagggcacgatagactcggaagcgggacaaaaaacagagtaacacgagagcactacagagagagctactgcagaggtcgagctcgaacaaactgagagagacaggaaaacagcaaggaaaaagaaaggagacgaggaggagaggtaaggtaaggaaggagaggaaagaacaggaggagagaaagcggaaatgcaaaggagaggcgaaaagaggagagcggtaaaaaaagggagaaagaaaagaaacgaaaaaggaggaagcgcagacaagagaaaaagaggagaaagagaaaaaagaagcagaaggaacgaaaggaagagagcgcacagaagggagagccgcaaaagactcaggagacagaaaacagcagagac

SEQ ID NO: 449518 - DNA, 1800 bp, Homo sapiens
gcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccaggtgagtatctcctctcttggagagggaggtttaaacggcaagtcctggagttggcagacgttttgaaaaattgccactcactcggtttagggaaactgaggccagagagggacaagtgacttgcccatggttgcatcaaatgaatggcagagtcagtttccatgtgatgtgcatttaagccttaaatgcgcctgggccctgccctcccgcagtggccgagggtctggcaaagtagacatgggtccgactaaatacaagtctttctgttccatgttgtatagggagctgtcttcggcagccccctcccagctagtgtcaattccaagtaggaggggtagcgcaagctccgcctgtggtctttggcgccaactgggtgggggcagcgtggggcgcggagttatcagctggaggtacagaccaagtttcctccctggcgccggccagtctgcggacggcccccgcctcggcacgctcggcggaaactgactgctccttggtcttctttcctcccccgcccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatga

SEQ ID NO: 449519 - DNA, 1013 bp, Homo sapiens
gcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatga

SEQ ID NO: 449520 - DNA, 430 bp, Homo sapiens
  misc_feature (1)..(1): n is a, c, g, or t
  misc_feature (67)..(67): n is a, c, g, or t
ncttgttcggttcttcgattggcacggtaccactacgttatttaaccaccccctcctgctatgtganctttttcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaa

SEQ ID NO: 449521 - DNA, 1283 bp, Homo sapiens
cacggccgcgaggccgtgccaccctgagccttccccaggtctcccctagtcctgtgtccgcgagccggtgaccttcagccgtccctcttgcattgctccttctcttttgcacctgagccggtagccgttgccattgtaatgaaagctcctcttccccaccctgcactagcccgaagaatgcagatcaaggattgttgggctttgattaggcgacagttattcgaagccaggaacacgcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaaaactgggtagtggtgatgaatgcaaaactttgtgaatgtgctttataaaagtgataattagacactttagaggatatacttggtgataatgtgaatgatgtaatcagactaacagttgaatcattgctgttggaggcagcacaaatttatgtgttacaacaatagtttaaaaacttgtactggatggaacccattttataaacagtcttatttggagtcatgtatataaaaatatatataaattagaaaagtagtatttgattaggataactttacaaattcaatagtatagccatcacttattataatggcaatcagaagagtgaggcttcttttttcaaacttttgtaatcagattaagattgaccattgctcctttacacagtattagtctagcattcaattatttctgttattaatggttgtagaaagttcaaatacatacgcagagttggaaagacgagttttagtctgagttctgtacgacggagttaacccgttagcacaagttattgcattagatgatctctgttgaatttaaatacataaacctgttgttaaacgcttttatactataaagccaccacattgtatggcatttgtttagaagtaagcaaatagaccaccggaatagaatagatggcctagaaatagatcaagacattctggtccgccatattagaaattta

SEQ ID NO: 449522 - DNA, 441 bp, Homo sapiens
ctcatgtgctttttgaaaagtttagtcataagataattatccaaccccacagtagtatttttgcttgcagtaccaaattgcacctatttcttacagcaaccttcagtaattgagaatgtaacactaaaatgcaaacttaatatgttatatagtctccggtagtcagatataattaaaataactacttaaatatcttctaaaagcaaaattaatattattttccccctttctctccagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaa

SEQ ID NO: 449523 - DNA, 193 bp, Homo sapiens
  misc_feature (39)..(39): n is a, c, g, or t
gaataagtccgaagcccgtgagtgaaccatcattataancgtgatgatcagctgtttgtcatattgctatcattctaaagtcatggacttcactttcggcaacaaaactaaataaggatggaacatttattgaatgaaaaatgcacttttgtttttccatttttttaaataataaaaatcagacaaacaggaa

SEQ ID NO: 449524 - DNA, 568 bp, Homo sapiens
aaattcaaggcggcccttgattagattctagttgtggatgggcttcccctgctacgtccgccccatgcgccaggccgctaggggcaggacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaa

SEQ ID NO: 449525 - DNA, 1257 bp, Homo sapiens
aaattcaaggcggcccttgattagattctagttgtggatgggcttcccctgctacgtccgccccatgcgccaggccgctaggggcaggacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaaaactgggtagtggtgatgaatgcaaaactttgtgaatgtgctttataaaagtgataattagacactttagaggatatacttggtgataatgtgaatgatgtaatcagactaacagttgaatcattgctgttggaggcagcacaaatttatgtgttacaacaatagtttaaaaacttgtactggatggaacccattttataaacagtcttatttggagtcatgtatataaaaatatatataaattagaaaagtagtatttgattaggataactttacaaattcaatagtatagccatcacttattataatggcaatcagaagagtgaggcttcttttttcaaacttttgtaatcagattaagattgaccattgctcctttacacagtattagtctagcattcaattatttctgttattaatggttgtagaaagttcaaatacatacgcagagttggaaagacgagttttagtctgagttctgtacgacggagttaacccgttagcacaagttattgcattagatgatctctgttgaatttaaatacataaacctgttgttaaacgcttttatactataaagccaccacattgtatggcatttgtttagaagtaagcaaatagaccaccggaatagaatagatggcctagaaatagatcaagacattctggtccgccatattagaaattta

SEQ ID NO: 449526 - DNA, 885 bp, Homo sapiens
  misc_feature (684)..(684): n is a, c, g, or t
  misc_feature (816)..(816): n is a, c, g, or t
  misc_feature (833)..(833): n is a, c, g, or t
  misc_feature (839)..(839): n is a, c, g, or t
  misc_feature (844)..(845): n is a, c, g, or t
  misc_feature (855)..(855): n is a, c, g, or t
  misc_feature (858)..(858): n is a, c, g, or t
  misc_feature (867)..(867): n is a, c, g, or t
  misc_feature (875)..(875): n is a, c, g, or t
aaattcaaggcggcccttgattagattctagttgtggatgggcttcccctgctacgtccgccccatgcgccaggccgctaggggcaggacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaaaaaaaaaaaaaatctcataaaaaaaaatcaatatactataacaataaccaaccatatcatcattcatctactttcctttcctcccctttatcctctttaaaaaaaaaaaaaactangtgggccgcttgggccaagtggtttttagatctgggcaaggtttttcctggcggccgaatttggggcttatttggccacattccccttatggggggcggttttaaattcaatggcccgggttttaaaacggngggactgggaaaacccnggggtnccaanntaatggctgnaanaatcccctntgcaggtngggatatagg

SEQ ID NO: 449527 - DNA, 808 bp, Homo sapiens
aaattcaaggcggcccttgattagattctagttgtggatgggcttcccctgctacgtccgccccatgcgccaggccgctaggggcaggacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaaaaaaaaaaaaaaaaaaaaaaaaaaaaaaaaaaaaaaaaaaaaaaaaaaaaaaaaaaaaaaaaaaaaaaaaaaaaaaaaaaaaaacttcggggggggccccgtgcccaatttgcccttatagggagccgtttaacaattaactggccgtggtttaaaaccgtctgaatgggaaaacccttggcgttccccacttaaatgccttggaagaaattccccttttccccagtgggggaattgcca

SEQ ID NO: 449528 - DNA, 1296 bp, Homo sapiens
aaattcaaggcggcccttgattagattctagttgtggatgggcttcccctgctacgtccgccccatgcgccaggccgctaggggcaggacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagcctcagctcctggcaacctccagtctcctttctgcttctaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaaaactgggtagtggtgatgaatgcaaaactttgtgaatgtgctttataaaagtgataattagacactttagaggatatacttggtgataatgtgaatgatgtaatcagactaacagttgaatcattgctgttggaggcagcacaaatttatgtgttacaacaatagtttaaaaacttgtactggatggaacccattttataaacagtcttatttggagtcatgtatataaaaatatatataaattagaaaagtagtatttgattaggataactttacaaattcaatagtatagccatcacttattataatggcaatcagaagagtgaggcttcttttttcaaacttttgtaatcagattaagattgaccattgctcctttacacagtattagtctagcattcaattatttctgttattaatggttgtagaaagttcaaatacatacgcagagttggaaagacgagttttagtctgagttctgtacgacggagttaacccgttagcacaagttattgcattagatgatctctgttgaatttaaatacataaacctgttgttaaacgcttttatactataaagccaccacattgtatggcatttgtttagaagtaagcaaatagaccaccggaatagaatagatggcctagaaatagatcaagacattctggtccgccatattagaaattta

SEQ ID NO: 449529 - DNA, 1195 bp, Homo sapiens
  misc_feature (60)..(60): n is a, c, g, or t
aatcattatcatcatacatacttatctatcatacttcattatcaacttatatttttatcnttatctcatttattaatattaatattatttaatatcactaccccccccaccccgctctcgagtccgggccgcaagtcccagacgctgcccatggaggcgtccagcgagccgccgctggatgctaagtccgatgtcaccaaccagcagtattaaaatgaagatactttatgtaaatatgaccagcgttgaaactaaaagttgagtgtaactgcagtaaaattgaataaatatctgcattccagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaaaactgggtagtggtgatgaatgcaaaactttgtgaatgtgctttataaaagtgataattagacactttagaggatatacttggtgataatgtgaatgatgtaatcagactaacagttgaatcattgctgttggaggcagcacaaatttatgtgttacaacaatagtttaaaaacttgtactggatggaacccattttataaacagtcttatttggagtcatgtatataaaaatatatataaattagaaaagtagtatttgattaggataactttacaaattcaatagtatagccatcacttattataatggcaatcagaagagtgaggcttcttttttcaaacttttgtaatcagattaagattgaccattgctcctttacacagtattagtctagcattcaattatttctgttattaatggttgtagaaagttcaaatacatacgcagagttggaaagacgagttttagtctgagttctgtacgacggagttaacccgttagcacaagttattgcattagatgatctctgttgaatttaaatacataaacctgttgttaaacgcttttatactataaagccaccacattgtatggcatttgtttagaagtaagcaaatagaccaccggaatagaatagatggcctagaaatagatcaagacattctggtccgccatattagaaattta

SEQ ID NO: 449530 - DNA, 607 bp, Homo sapiens
aaattcaaggcggcccttgattagattctagttgtggatgggcttcccctgctacgtccgccccatgcgccaggccgctaggggcaggacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagcctcagctcctggcaacctccagtctcctttctgcttctaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaa

SEQ ID NO: 449531 - DNA, 506 bp, Homo sapiens
  misc_feature (60)..(60): n is a, c, g, or t
aatcattatcatcatacatacttatctatcatacttcattatcaacttatatttttatcnttatctcatttattaatattaatattatttaatatcactaccccccccaccccgctctcgagtccgggccgcaagtcccagacgctgcccatggaggcgtccagcgagccgccgctggatgctaagtccgatgtcaccaaccagcagtattaaaatgaagatactttatgtaaatatgaccagcgttgaaactaaaagttgagtgtaactgcagtaaaattgaataaatatctgcattccagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaa

SEQ ID NO: 449532 - DNA, 820 bp, Homo sapiens
  misc_feature (60)..(60): n is a, c, g, or t
aatcattatcatcatacatacttatctatcatacttcattatcaacttatatttttatcnttatctcatttattaatattaatattatttaatatcactaccccccccaccccgctctcgagtccgggccgcaagtcccagacgctgcccatggaggcgtccagcgagccgccgctggatgctaagtccgatgtcaccaaccagcagtattaaaatgaagatactttatgtaaatatgaccagcgttgaaactaaaagttgagtgtaactgcagtaaaattgaataaatatctgcattccaggtaatgttactactaatgtattattttgtcctgtcttattaaagccttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcaggtttgtgatttaactcatccagttttagctcagcttttctgtaatcattgcataaaaagatgtataaaatctttctacgggaaaactttaatggtttttatttgtagattgatatgctttacgtttactagtagtatatgcaagagacattaatttgtcttctttgggaatttgataaattattttcaatataatgtgctgaagttgtgtactgcgccatttgatcgcttgaacagtactcctctctgagtatatttaggaaagttttatcttcaatggcaggatatttactttgcatttaaatgttttattcttattcc

SEQ ID NO: 449533 - DNA, 807 bp, Homo sapiens
aaattcaaggcggcccttgattagattctagttgtggatgggcttcccctgctacgtccgccccatgcgccaggccgctaggggcaggacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaaaaaaccctaactgaaccctcatccccacactgctctacgttctattcatgcggagcactcgtattagtccccccccattccccttccccttcatcattcgcaccctttaaaaaaaaatttttcccccccttgtgcccgtcttttttagactctggtcatctttattttgggttcccaacttgtgtcttcttggtcaaatccccgttctgtgggaggtgtttctcccaattatatgccct

SEQ ID NO: 449534 - DNA, 851 bp, Homo sapiens
  misc_feature (650)..(650): n is a, c, g, or t
  misc_feature (782)..(782): n is a, c, g, or t
  misc_feature (799)..(799): n is a, c, g, or t
  misc_feature (805)..(805): n is a, c, g, or t
  misc_feature (810)..(811): n is a, c, g, or t
  misc_feature (821)..(821): n is a, c, g, or t
  misc_feature (824)..(824): n is a, c, g, or t
  misc_feature (833)..(833): n is a, c, g, or t
  misc_feature (841)..(841): n is a, c, g, or t
aaattcaaggcggcccttgattagattctagttgtggatgggcttcccctgctacgtccgccccatgcgccaggccgctaggggcaggacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaaaaaaaaaaaaaaaaaaaaaaaaaaaaaaaaaaaaaaaaaaaaaaaaaaaaaaaaaaaaaaaaaaaaaaaaaaaaaaaactangtgggccgcttgggccaagtggtttttagatctgggcaaggtttttcctggcggccgaatttggggcttatttggccacattccccttatggggggcggttttaaattcaatggcccgggttttaaaacggngggactgggaaaacccnggggtnccaanntaatggctgnaanaatcccctntgcaggtngggatatagg

SEQ ID NO: 449535 - DNA, 844 bp, Homo sapiens
  misc_feature (60)..(60): n is a, c, g, or t
  misc_feature (643)..(643): n is a, c, g, or t
  misc_feature (775)..(775): n is a, c, g, or t
  misc_feature (792)..(792): n is a, c, g, or t
  misc_feature (798)..(798): n is a, c, g, or t
  misc_feature (803)..(804): n is a, c, g, or t
  misc_feature (814)..(814): n is a, c, g, or t
  misc_feature (817)..(817): n is a, c, g, or t
  misc_feature (826)..(826): n is a, c, g, or t
  misc_feature (834)..(834): n is a, c, g, or t
aatcattatcatcatacatacttatctatcatacttcattatcaacttatatttttatcnttatctcatttattaatattaatattatttaatatcactaccccccccaccccgctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaaaaaaaaaaaaaaaaaaaaaaaaaaaaaaaaaaaaaaaaaaaaaaaaaaaaaaaaaaaaaaaaaaaaaaaaaaaaaaaactangtgggccgcttgggccaagtggtttttagatctgggcaaggtttttcctggcggccgaatttggggcttatttggccacattccccttatggggggcggttttaaattcaatggcccgggttttaaaacggngggactgggaaaacccnggggtnccaanntaatggctgnaanaatcccctntgcaggtngggatatagg

SEQ ID NO: 449536 - DNA, 826 bp, Homo sapiens
  misc_feature (625)..(625): n is a, c, g, or t
  misc_feature (757)..(757): n is a, c, g, or t
  misc_feature (774)..(774): n is a, c, g, or t
  misc_feature (780)..(780): n is a, c, g, or t
  misc_feature (785)..(786): n is a, c, g, or t
  misc_feature (796)..(796): n is a, c, g, or t
  misc_feature (799)..(799): n is a, c, g, or t
  misc_feature (808)..(808): n is a, c, g, or t
  misc_feature (816)..(816): n is a, c, g, or t
aaattcaaggcggcccttgattagattctagttgtggatgggcttcccctgctacgtccgccccatgcgccaggccgctaggggcaggacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaaaaaaaaaaaaaaaaaaaaaaaaaaaaaaaaaaaaaaaaaaaaaaaaaaaaaaactangtgggccgcttgggccaagtggtttttagatctgggcaaggtttttcctggcggccgaatttggggcttatttggccacattccccttatggggggcggttttaaattcaatggcccgggttttaaaacggngggactgggaaaacccnggggtnccaanntaatggctgnaanaatcccctntgcaggtngggatatagg

SEQ ID NO: 449537 - DNA, 702 bp, Homo sapiens
  misc_feature (501)..(501): n is a, c, g, or t
  misc_feature (633)..(633): n is a, c, g, or t
  misc_feature (650)..(650): n is a, c, g, or t
  misc_feature (656)..(656): n is a, c, g, or t
  misc_feature (661)..(662): n is a, c, g, or t
  misc_feature (672)..(672): n is a, c, g, or t
  misc_feature (675)..(675): n is a, c, g, or t
  misc_feature (684)..(684): n is a, c, g, or t
  misc_feature (692)..(692): n is a, c, g, or t
aggcgtgccgcggagtcctattctgagacagacgccaggtggctacccattgccaggcagcaaggccggaggacgccgtgcagcacgcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaaaaaaaaaaaaaaaaaaaaaaaaaaaaaaaaaaaaaaaaaaaaaaaaaaaaaaactangtgggccgcttgggccaagtggtttttagatctgggcaaggtttttcctggcggccgaatttggggcttatttggccacattccccttatggggggcggttttaaattcaatggcccgggttttaaaacggngggactgggaaaacccnggggtnccaanntaatggctgnaanaatcccctntgcaggtngggatatagg

SEQ ID NO: 449538 - DNA, 923 bp, Homo sapiens
aactgcgcagctgctgactggcgggccgccaggcgcgtgcgtagagacgcccacacgcccgctgatgcgcacgcgccctgggccgcgcgtgcgcgcgtggggttccggaatgagccggggaaagcaaggggaaggtttggggttggctcccggtttcgcgcatgcgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaattggtagagctttgtgttcagtatggacagaatgaggagggaatggtaggcgagcttatagccttctgcaccagcacacataaagttggccttacctcagagatcctgaactcttttgagcatgagtttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagctgttcttttgcttccgtgttcaccataaatc

SEQ ID NO: 449539 - DNA, 2619 bp, Homo sapiens
aactgcgcagctgctgactggcgggccgccaggcgcgtgcgtagagacgcccacacgcccgctgatgcgcacgcgccctgggccgcgcgtgcgcgcgtggggttccggaatgagccggggaaagcaaggggaaggtttggggttggctcccggtttcgcgcatgcgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaattggtagagctttgtgttcagtatggacagaatgaggagggaatggtaggcgagcttatagccttctgcaccagcacacataaagttggccttacctcagagatcctgaactcttttgagcatgagtttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggatgctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctgcctgtcaccccagatgtcctcatcatcccgtcagagctgaggtacttcgtgaaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctgaggcttctgtcctctgctgttctctgctgtgtgggcccttaaagtcttagccaagagccaagacatagccctgtgacaaggtgaacagttgggtgggaaaggagagaggagccagccagggaggggcagctgcagtgaccaggcccagcagggaggacttgtgcagccgggcctgcctctgagtggtgcctctcctggaaggaagctcttgcttctcagtccatgctccgtgtccagaagtaagccagctgtggatcccgcccactcagaaaaggcgagaaggctttgtgattttctacatgaatcaaacacagaaacaacttttggagaaattaaattctgagtgtgacttctga

SEQ ID NO: 449540 - DNA, 2871 bp, Homo sapiens
aactgcgcagctgctgactggcgggccgccaggcgcgtgcgtagagacgcccacacgcccgctgatgcgcacgcgccctgggccgcgcgtgcgcgcgtggggttccggaatgagccggggaaagcaaggggaaggtttggggttggctcccggtttcgcgcatgcgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaattggtagagctttgtgttcagtatggacagaatgaggagggaatggtaggcgagcttatagccttctgcaccagcacacataaagttggccttacctcagagatcctgaactcttttgagcatgagtttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggatgctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctgaggcttctgtcctctgctgttctctgctgtgtgggcccttaaagtcttagccaagagccaagacatagccctgtgacaaggtgaacagttgggtgggaaaggagagaggagccagccagggaggggcagctgcagtgaccaggcccagcagggaggacttgtgcagccgggcctgcctctgagtggtgcctctcctggaaggaagctcttgcttctcagtccatgctccgtgtccagaagtaagccagctgtggatcccgcccactcagaaaaggcgagaaggctttgtgattttctacatgaatcaaacacagaaacaacttttggagaaattaaattctgagtgtgacttctgagtttgacctttcttctattttcttttatttatttattttgtttttagacggagtctcgatctgtcgcccaggctggagtgcagtggtgagatctcggctcactgcaagctctgccgcccgggttcatgccattctcctgcctcagcctcctgagtagctgggactacaggcacccaccacca

SEQ ID NO: 449541 - DNA, 1309 bp, Homo sapiens
catctacattttcttttctgctccccttttttttcatttcccaaatttgtgacctgaaaacaaatgtggacatcctgtttgtggaggataaactgggaattttctctgaaggattttcttcactaccagtacaacatccagctctgcagagaatcaggccctgacaaatttgttgagttgaagttgggcagctccgttctgccgtcatccttgatgggaaggggcatgtgaagcgactcgcgtgtgaagcgagacgggtgcggctccttggctgaggtttgagattcaggtcagcctggctacacacccgcctcatgatggtgccaactttgcatcctcttgcacagtacggtgctggctaatggccttccttgatcttgattatgagggattcctgtgctttcccttctcaacctggtgtcctgcgtccctcctcatgtggggacagactgagctccttgtgggtgggtctttaaacttccccagaggcatcctcctcttgttgctgtgccttggccatttaccttctctctggtttattaaattctccagtcctccctgaagagaaatgggctgaaaaacagagttctgttttcatgctttcttttctttcccagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctgaggcttctgtcctctgctgttctctgctgtgtgggcccttaaagtcttagccaagagccaagacatagccctgtgacaaggtgaacagttgggtgggaaaggagagaggagccagccagggaggggcagctgcagtgaccaggcccagcagggaggacttgtgcagccgggcctgcctctgagtggtgcctctcctggaaggaagctcttgcttctcagtccatgctccgtgtccagaagtaagccagctgtggatcccgcccactcagaaaaggcgagaaggctttgtgattttctacatgaatcaaacacagaaacaacttttggagaaattaaattctgagtgtgacttctga

SEQ ID NO: 449542 - DNA, 775 bp, Homo sapiens
gtgaggaaagaactctgtgctgagcagctgctggcccacagcagctgaggaccatcgttgcaacgatggtcctcagctcaacgttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctgaggcttctgtcctctgctgttctctgctgtgtgggcccttaaagtcttagccaagagccaagacatagccctgtgacaaggtgaacagttgggtgggaaaggagagaggagccagccagggaggggcagctgcagtgaccaggcccagcagggaggacttgtgcagccgggcctgcctctgagtggtgcctctcctggaaggaagctcttgcttctcagtccatgctccgtgtccagaagtaagccagctgtggatcccgcccactcagaaaaggcgagaaggctttgtgattttctacatgaatcaaacacagaaacaacttttggagaaattaaattctgagtgtgacttctga

SEQ ID NO: 449543 - DNA, 285 bp, Homo sapiens
aatcggagcctgtccagatggatgggtgtgaagtagaacaaactgtcctttactcccagtgtcccatgggaaacagcgtctctgttcataacagagtgcagttctgagctgcctccctcggggtgggctctgcctccagcctgaggcatcccacctgttgcgcagctgttctaactcaactgcactcacttttctcactcttctgtttgttcttttgccatactagctccggctcccaccttgtctttgtcccgtcattgagagatgtgcaccatgagcctgtgt

SEQ ID NO: 449544 - DNA, 447 bp, Homo sapiens
ttcaacttaaagatattcatggttccttcgttagaagccttcttcaggttggccttgacttgcctaaaacctcagtgaggacttgagtaaagggcagacttggagatggggtggggttcatgctgattccctggaattgtgctatggggtctcctgtggccagatggaaggccagattcagcaaccaaatatcggaaaattggcaaaggttttagaaggtttaaactggccagatgtccaggcacccttcctgcttctgtaaaatgactgactttaatattttacaatgtgctgtattttctcttcttggcaagtgaaatgtcttaaacataatacttttttccacttctgggattgtagttctgacctgtaagatagaagaacttggcagcgaactcaaggaacattacaagattgaagctttcactcctttgctagccccagcac

SEQ ID NO: 449545 - DNA, 2689 bp, Homo sapiens
aactgcgcagctgctgactggcgggccgccaggcgcgtgcgtagagacgcccacacgcccgctgatgcgcacgcgccctgggccgcgcgtgcgcgcgtggggttccggaatgagccggggaaagcaaggggaaggtttggggttggctcccggtttcgcgcatgcgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaattggtagagctttgtgttcagtatggacagaatgaggagggaatggtaggcgagcttatagccttctgcaccagcacacataaagttggccttacctcagagatcctgaactcttttgagcatgagtttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggatgctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctgaggcttctgtcctctgctgttctctgctgtgtgggcccttaaagtcttagccaagagccaagacatagccctgtgacaaggtgaacagttgggtgggaaaggagagaggagccagccagggaggggcagctgcagtgaccaggcccagcagggaggacttgtgcagccgggcctgcctctgagtggtgcctctcctggaaggaagctcttgcttctcagtccatgctccgtgtccagaagtaagccagctgtggatcccgcccactcagaaaaggcgagaaggctttgtgattttctacatgaatcaaacacagaaacaacttttggagaaattaaattctgagtgtgacttctga

SEQ ID NO: 449546 - DNA, 2564 bp, Homo sapiens
aactgcgcagctgctgactggcgggccgccaggcgcgtgcgtagagacgcccacacgcccgctgatgcgcacgcgccctgggccgcgcgtgcgcgcgtggggttccggaatgagccggggaaagcaaggggaaggtttggggttggctcccggtttcgcgcatgcgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaattttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggatgctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctgaggcttctgtcctctgctgttctctgctgtgtgggcccttaaagtcttagccaagagccaagacatagccctgtgacaaggtgaacagttgggtgggaaaggagagaggagccagccagggaggggcagctgcagtgaccaggcccagcagggaggacttgtgcagccgggcctgcctctgagtggtgcctctcctggaaggaagctcttgcttctcagtccatgctccgtgtccagaagtaagccagctgtggatcccgcccactcagaaaaggcgagaaggctttgtgattttctacatgaatcaaacacagaaacaacttttggagaaattaaattctgagtgtgacttctga

SEQ ID NO: 449547 - DNA, 2852 bp, Homo sapiens
aactgcgcagctgctgactggcgggccgccaggcgcgtgcgtagagacgcccacacgcccgctgatgcgcacgcgccctgggccgcgcgtgcgcgcgtggggttccggaatgagccggggaaagcaaggggaaggtttggggttggctcccggtttcgcgcatgcgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaattggtagagctttgtgttcagtatggacagaatgaggagggaatggtaggcgagcttatagccttctgcaccagcacacataaagttggccttacctcagagatcctgaactcttttgagcatgagtttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggatgctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggtaggtttgaactctgctttttcccagaaacaccagaacccagtctttgactttcccttctagaccacccggcactcacccctcatgggtcagctgatggggatggggcctctagcaccctgccctgtggccttgtttctttggggaggtggtgggaccagaaaacaaacaactctgtcagtaaaatgcttgagtaaacagtgtcctctcctccctccccaagagaacgagagcccagatgactaggaaggccctcaaatgagggctttcaccaggccacatagaggtgacctggggaagatttcatatgtacacttgcctgtcctctgcctcccaaattctgatatgacctccaagtgggctcagctgggaataccttgaagaagctattgggtcattttgatctctgccaccctttagccctgcctgccttggagttaggtcccttacaaggaatctgcctagaccagtccccctcttgccaaacaagagttagttcaatctcaagaggttaaaaaaaagtttttcacatgagaaagcagtaaacagctagatcaggtttgtctccaagtttaggagctgattgtcattctgccaagtcacctcattcttctgtttgaaagacttaaaaggaattcaaagctttctagtgacaagttaacatatgt

SEQ ID NO: 449548 - DNA, 1869 bp, Homo sapiens
aactgcgcagctgctgactggcgggccgccaggcgcgtgcgtagagacgcccacacgcccgctgatgcgcacgcgccctgggccgcgcgtgcgcgcgtggggttccggaatgagccggggaaagcaaggggaaggtttggggttggctcccggtttcgcgcatgcgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaattggtagagctttgtgttcagtatggacagaatgaggagggaatggtaggcgagcttatagccttctgcaccagcacacataaagttggccttacctcagagatcctgaactcttttgagcatgagtttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgttaggcctttcctggatgctacgccatgaaccaggtggagcaattgtctactgacaagtctatttgcagaacattttcaagcaggtatacgaacacttttgcaggcccagaagcttcggtccactggtttggccgattgcgagattgcccatgagctgttacaccagcggcttagtagtcgaactgtgagaggaaacgcgt

SEQ ID NO: 449549 - DNA, 4737 bp, Homo sapiens
gttgctccagtgaagcttcttggggtgggaggggagggaatggggtcagggggcttgaggtgcctagagatggcagctccctctcccgcctcctccccaggtggttcaggctgcagggtggccagcatggcccttcagggcccttatcttggcctggaagtaggtgtacatggccagcaggcccatgaaggacagggaatagagccccacacagaggctgatgtccaggtaagagaagccccctcccagcacctgcagccactggcctcggccccgtccagctcgggcctccagctggccctcagggatgtcgaccagctgcttggagctgcggcccacgcgcctgacctccaaagggccccagaggcggttcttctcagccctggactcagccagcaatgcagcccctgtgtctcgcttgctcaagtgccactgcccaagcggctgctcctgctcattcctctgaagctctgccatgtgctcaggaggctcctggcctggtgcagctctgaggccagggtgcagcttcgggggtcgacttgcctcaggtccctcagccggcacatgtggggtggtgtttgtgggggacttcatcatctcaggcttcccagggtccagagttgaattccggctttccagctccagggctcccatcgccagctctggggcggctgccacattctgcacatccctccgggcagctgacccagctgcagggaagtccaggatgatgttgcttggggagaagtgggccttgaggaagttgagggtggcttccacgtcccacacgggcacatccaggcgttcattgtggcaggcagaacaaagttcacggggtggccactgcaccttggggaactgggggtcctcgctgggggcacctgcaaggcgagcattgaccctgttgtggctagaccagagccagaggacagcggcgttgggactccccacccggtgcatggaggcagcagccatctgctcgaagtggctagcgcagtctcggcagccgaagaagtagcgcacgtagcctcggatggctgggaggacctccttggccttggctgcttcctgtgagtggtctacattttgccgagctgcctgcacagtcaagaagtggaagaggacccacagggagcagggaaagccccggaaatgcggctcactcccctggcagccaatccagttcaccttcttggcaagaacggcaccctctttcctgtcgtccagggcagttttaaagaaactgtagggaattttatttctcttctgcctcttgagccattcattcacggagtgcaggaagttctggactaagggccggccagggaaatacttggccagcactgccacaaactttttcagggccaccaggcgctgcccttccaggaccgggaacctgcccacttctatccgcaggatgtagtgcagtgcagattccaggtcagccatgtagatcttggagcgatctgccaatttccaaacagtgggagctatcttgttagcagtggttggtgcaactgtggtctgggcagcctccctggtgagcccagagagtctctgcaggtaagcggtatagaaggacctggattccatgagcacggggactcgggagacagagccattccggaacagcaggtagcaagaggggaagtcggtgacaccaaactttctcaccacattggcctctgtgttcagcaccctgcgcaccgccacgcctttgtgctgggacaggtccagagccacctctctacccaggtaggagcctcccttttcaaagatcgacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 449550 - DNA, 6907 bp, Homo sapiens
ttcagtttctaaaaacaactacattacctgcaatgcacaatgaaacaaagtatgccctctcttcacacaaaaaaaattctattctgttattttcacttaacaaacagctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 449551 - DNA, 6704 bp, Homo sapiens
gaaaaaacaactaaacgccgctttcctgcctcaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 449552 - DNA, 7332 bp, Homo sapiens
ttcagtttctaaaaacaactacattacctgcaatgcacaatgaaacaaagtatgccctctcttcacacaaaaaaaattctattctgttattttcacttaacaaacagctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcaggtaagagaggtggaaggtaaggggtagcgagtgggacctactcccttcttcccatgaccacccaactcaggaggagaggatggcccgggaccctgctgcctgtctagggtcatttgtggactgtgtcctccacatactgttgtgttaccaagagtgggccctcttcctcagcaggcttgctccccgcctatatctgtggggcccaccctcttcccccttttcctcactgccttcagaggccccagttccttattcccatgtggttcctttcctgcccagtctgttttgtcccatctcccttttcttgtctcaagatccttcatccctcactttctcctttttttcttttctcccctttcctgaccatccctcgacctcagcaggccttcttcaacactactatctcctttcctccatccctgcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 449553 - DNA, 7257 bp, Homo sapiens
ttcagtttctaaaaacaactacattacctgcaatgcacaatgaaacaaagtatgccctctcttcacacaaaaaaaattctattctgttattttcacttaacaaacagctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcaggtaagagaggtggaaggtaaggggtagcgagtgggacctactcccttcttcccatgaccacccaactcaggaggagaggatggcccgggaccctgctgcctgtctagggtcatttgtggactgtgtcctccacatactgttgtgttaccaagagtgggccctcttcctcagcaggcttgctccccgcctatatctgtggggcccaccctcttcccccttttcctcactgccttcagaggccccagttccttattcccatgtggttcctttcctgcccagtctgttttgtcccatctcccttttcttgtctcaagatccttcatccctcactttctcctttttttcttttctcccctttcctgaccatccctcgacctcagcaggccttcttcaacactactatctcctttcctccatccctgcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 449554 - DNA, 6131 bp, Homo sapiens
ttcagtttctaaaaacaactacattacctgcaatgcacaatgaaacaaagtatgccctctcttcacacaaaaaaaattctattctgttattttcacttaacaaacagctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcaggtaagagaggtggaaggtaaggggtagcgagtgggacctactcccttcttcccatgaccacccaactcaggaggagaggatggcccgggaccctgctgcctgtctagggtcatttgtggactgtgtcctccacatactgttgtgttaccaagagtgggccctcttcctcagcaggcttgctccccgcctatatctgtggggcccaccctcttcccccttttcctcactgccttcagaggccccagttccttattcccatgtggttcctttcctgcccagtctgttttgtcccatctcccttttcttgtctcaagatccttcatccctcactttctcctttttttcttttctcccctttcctgaccatccctcgacctcagcaggccttcttcaacactactatctcctttcctccatccctgcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 449555 - DNA, 1837 bp, Homo sapiens
gaaggagggtctacaggtttccaccaaacagaagatggaatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 449556 - DNA, 5243 bp, Homo sapiens
  misc_feature (5097)..(5097): n is a, c, g, or t
  misc_feature (5125)..(5125): n is a, c, g, or t
  misc_feature (5129)..(5129): n is a, c, g, or t
  misc_feature (5145)..(5145): n is a, c, g, or t
  misc_feature (5159)..(5159): n is a, c, g, or t
  misc_feature (5166)..(5166): n is a, c, g, or t
  misc_feature (5179)..(5179): n is a, c, g, or t
  misc_feature (5195)..(5195): n is a, c, g, or t
  misc_feature (5222)..(5222): n is a, c, g, or t
ttcagtttctaaaaacaactacattacctgcaatgcacaatgaaacaaagtatgccctctcttcacacaaaaaaaattctattctgttattttcacttaacaaacagctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcaggtaagagaggtggaaggtaaggggtagcgagtgggacctactcccttcttcccatgaccacccaactcaggaggagaggatggcccgggaccctgctgcctgtctagggtcatttgtggactgtgtcctccacatactgttgtgttaccaagagtgggccctcttcctcagcaggcttgctccccgcctatatctgtggggcccaccctcttcccccttttcctcactgccttcagaggccccagttccttattcccatgtggttcctttcctgcccagtctgttttgtcccatctcccttttcttgtctcaagatccttcatccctcactttctcctttttttcttttctcccctttcctgaccatccctcgacctcagcaggccttcttcaacactactatctcctttcctccatccctgcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgggnaataattgggcgagaatgaccagttccnttanaatggattgggcaaancccaaaagccaagnttttttnggccttggagggnccccttaaaaaacttnggggggggttttaaaaacctttggggngggggggggggggccaatttg

SEQ ID NO: 449557 - DNA, 4158 bp, Homo sapiens
ttcagtttctaaaaacaactacattacctgcaatgcacaatgaaacaaagtatgccctctcttcacacaaaaaaaattctattctgttattttcacttaacaaacagctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcaggtaagagaggtggaaggtaaggggtagcgagtgggacctactcccttcttcccatgaccacccaactcaggaggagaggatggcccgggaccctgctgcctgtctagggtcatttgtggactgtgtcctccacatactgttgtgttaccaagagtgggccctcttcctcagcaggcttgctccccgcctatatctgtggggcccaccctcttcccccttttcctcactgccttcagaggccccagttccttattcccatgtggttcctttcctgcccagtctgttttgtcccatctcccttttcttgtctcaagatccttcatccctcactttctcctttttttcttttctcccctttcctgaccatccctcgacctcagcaggccttcttcaacactactatctcctttcctccatccctgcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctggtgaactaccaatctgtaacccctagcatttctagacctcaaatttcaatacacactggacggccatcctctcattgttcactgtgggagaccttgctgcggctccctggccttcctcag

SEQ ID NO: 449558 - DNA, 559 bp, Homo sapiens
agtagctgggattacaggcatccactaccacgctcagctatttttttttgtatttttgctagagatggggtttcaccatgttgccaggctggtctagaactcctgacctcaagtgatccacccaccttagcctcccaaagtgctgggattacaggtgtgagccaccgcacccagccctatttttcatttttgtaacagaaaaatagctaatgcagaattgaaaaattcctaaccattaaggttatgagacactaaaatagagtatcatcttatgcaacttattccccagactggaagtctggttagtgacacgaggaatgaatgaaataacctgctaacgtttctttcaggtcagggacccaaggtttatactgaccccctctcctcacctccctcatgccttgacctctgaccctcttatctttggaggttttcacaccagacactgcagcagacacccatgataagtaccatgactccaatgagtgcccagggcgtccaggcaggcgtccgttcaacagccatcctacctgagcagcagcagcagcagcaacagcag

SEQ ID NO: 449559 - DNA, 400 bp, Homo sapiens
gtaagagcctgggattgtgagactagggggatgaggcaagctgctctgcatactctcggccctgattccctctctccttcttccctccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggtacccaaagtagtggtgagctaggaagagatgcagaggtataagggagcatttgacttgggaaagcctgtgcctgaaagtggtgggactgg

SEQ ID NO: 449560 - DNA, 413 bp, Homo sapiens
agcggcccttatggtgtgacagtgcctccggacctcctgcaccacccaaaccctggttctataacacaccttaactacaggcaaggctccataggcctgtacacccagaaccagccactacctgcaggtgagtgccagccactaggaatgctggagggacctacctgtacactccccctgcccaaaggatgatgccattcccctgaggagctatggatgtcaaggacactgagcaagagacagagggatgaggagcctagaggtcagcccactctccttttcaggtggccctcgtgtggacccataccgtcctgtgcgcttaccaatgcagaagctgcccacccgaccaacttaccctggagtgctgcccacaaccatgactggcgtcatgggtttagaaccctcctcttata

SEQ ID NO: 449561 - DNA, 322 bp, Homo sapiens
cagtggtggtcggaggcagggtggccgcaacatctctgtggagacagccagtctggatgtctatgccaagtacgtgctgcgcagcatctgccaacaggtcagtttcaccttcctcccacacctcctaaatgcctctgtgtaatatagttctgtttccagcccatgatcacaccagctccctactatacattgtgttccttaacaactccagcccatcccccatattcctaaccccctcactggttgttcccagtccctgattgtcagcttcctcaggaatgggtaggagaacgttgccttaagtctctgtgtgaggacagca

SEQ ID NO: 449562 - DNA, 320 bp, Homo sapiens
atgttacattcctttctgagatgatgtgtgggacagcatgtggggtaaccaaccacactttgtccctcaacaatttctgggatttctatttgatcactcttattattgccttaggtgtgtccctctctcttttggcccacctttttgtgttctcctaacttatgtttcctcattcccttcctccagcggaccctcgaagtgagagtgagcgggtggaattctttaacttagtactgctgttctgtgaactgattcgacatgatgttttctcccacaacatgtatacttgcactctcatctcccgaggggaccttgccttt

SEQ ID NO: 449563 - DNA, 694 bp, Homo sapiens
ttgagacggagtctcgctcttgtcgctcaggctggagtacagtggtgcgatctcggctcactgcaacctctgcctcccaagttcaaacaattctcccgcctcagcctcttgagtaactgggattacaggtcgcccatcaccacgcccagctaatttttgtatttttagtagagatggggttttgccatgttggccaggctggtcttgaactcctgacctcaggtgatccgcctgtctcagcctccctaaatgtagtctttcttaaagatggggacatagaggtccctttcagacctccaggagtctgtgattcaatgttgcaggagatcaggaattggcatcagattgttgggtagctgggggtaacacgatgatgactagcctgggtgtggggcctctatcacagaacttggaccagtggaccatgcgccagtcttccttggagctgcagctcatgatcaagcagacccctaacaatgtgagtagtgcctggaccctccctttcctgtgctcacgttcagctccatgtgtcagggaggcggtccaccacagaagaacctagatcctacccttgggctcttgagctgaaagataagaggggatgggaaaatggtgaacaagtggagctgatgataagggaaatgggttgagagtgttggagctctgagctgtggggaagcttggtggtggtggt

SEQ ID NO: 449564 - DNA, 547 bp, Homo sapiens
aactcaggcgtcccaactcagattggaactaagctttcctgaaactctggcctttgtccctgagccatctgactgacttgttgtggccctggcaggtggggggcatgtttgacacggtgcagcgcagcacccagcagaccacggagtgggccatgctcctcctggagatcatcatcagcggcactgtcgacatgcagtccaacaagtaaagcatccccacccgctccctgcagtttcatacccaagaagctccccctactcccatgccaggtgcacccactgagattggtgtggctgttactgtggactccgtggccctgggctccccatacagttttcgtgacctagggatgacatattaagcacctctccctgcattgtgtcctctgctgaggcctttttctatcttcacctctttcttactttggttttctctctggcttcctgtctcagtgagctcttcactactgtgttggacatgctgagcgtgctcatcaatgggacattggctgcagacatgtctagcatctcgcaaggtagcatggag

SEQ ID NO: 449565 - DNA, 548 bp, Homo sapiens
aaaaaactcaagcatgaactcaggcgtcccaactcagattggaactaagctttcctgaaactctggcctttgtccctgagccatctgactgacttgttgtggccctggcaggtggggggcatgtttgacacggtgcagcgcagcacccagcagaccacggagtgggccatgctcctcctggagatcatcatcagcggcactgtcgacatgcagtccaacaagtaaagcatccccacccgctccctgcagtttcatacccaagaagctccccctactcccatgccaggtgcacccactgagattggtgtggctgttactgtggactccgtggccctgggctccccatacagttttcgtgacctagggatgacatattaagcacctctccctgcattgtgtcctctgctgaggcctttttctatcttcacctctttcttactttggttttctctctggcttcctgtctcagtgagctcttcactactgtgttggacatgctgagcgtgctcatcaatgggacattggctgcagacatgtctagcatctcg

SEQ ID NO: 449566 - DNA, 386 bp, Homo sapiens
ttgggccaacgcaccgtcaagcagacccctaacaaggagatgaactccctcttggagaacatcgccaaggccacaatcgaggttttccaacagtcagcagagacagggtcatcttctggaagtactgcaagcaacatgcccagcattttttgtatttttgctagagatggggtttcaccatgttgccaggctggtctagaactcctgacctcaagtgatccacccaccttagcctcccaaagtgctgggattacaggtgtgagccaccgcacccagccacagtttttttttaagcccataaatacttcagtgtgtgtctataaaaggagggtgattctgcccccagggggacactgcagtgtctggggataatctgtgcatgtcac

SEQ ID NO: 449567 - DNA, 7373 bp, Homo sapiens
tagagccagcctttcagggtttaataggttctttctcatgcatacatagtttctaatgttcacaatagccccttgaaggaggtgttagcgcacctatttttcagatgccggaactaagaaacgaactgatctgtaatagacggagttcctaaccaatgcaaatattattgaagacttttctaggccaaaaccgagctaggctatgggaaccgaagtccagtcagaactcagcaccacagaggcctccttcttccctggtttgcatccccagctcattctgcgcctccggaacgtttcatagatttttgctgagtgaaatcgacttgctgccgccaccgccgaaaaactcccggggcacagagctccgcccccaccgggccaggccccacctcctctgcagtcggtattgtccgatggttcccggcgtacctcggcttccctcggtagtttccggcaatggtcgagagtttctaacgtgcccccttgttgtctctcggccgccgtcctctcaaccaccgccccccttttcggctccctctcccccttcccgttcccccagtcagcctggccctgctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 449568 - DNA, 7187 bp, Homo sapiens
ttcagtttctaaaaacaactacattacctgcaatgcacaatgaaacaaagtatgccctctcttcacacaaaaaaaattctattctgttattttcacttaacaaacagctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcaggtaagagaggtggaaggtaaggggtagcgagtgggacctactcccttcttcccatgaccaccctcttcccccttttcctcactgccttcagaggccccagttccttattcccatgtggttcctttcctgcccagtctgttttgtcccatctcccttttcttgtctcaagatccttcatccctcactttctcctttttttcttttctcccctttcctgaccatccctcgacctcagcaggccttcttcaacactactatctcctttcctccatccctgcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 449569 - DNA, 7142 bp, Homo sapiens
ttcagtttctaaaaacaactacattacctgcaatgcacaatgaaacaaagtatgccctctcttcacacaaaaaaaattctattctgttattttcacttaacaaacagctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcaggtaagagaggtggaaggtaaggggtagcgagtgggacctactcccttcttcccatgaccacccaactcaggaggagaggatggcccgggaccctgctgcctgtctagggtcatttgtggactgtgtcctccacatactgttgtgttaccaagagtgggccctcttcctcagcaggcttgctccccgcctatatctgtggggcccaccctcttcccccttttcctcactgccttcagaggccccagttccttattcccatgtggttcctttcctgcccagtctgttttgtcccatctcccttttcttgtctcaagatccttcatccctcactttctcctttttttcttttctcccctttcctgaccatccctcgacctcagcaggccttcttcaacactactatctcctttcctccatccctgcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggtacccaaagtagtggtgagctaggaagagatgcagaggtataagggagcatttgacttgggaaagcctgtgcctgaaagtggtgggactggtcagaactttcggagacatcaagaatacttatctggccacatagcccataaccacagaagtctcgagctggaagggaccctggagaccaatagtttcatgactacttccttaacagttctttgaggcccagagaggggaaattgtttatctgactcaaggaaaaatctgggctgggtgtggtagctcacactggtagtcccagcacttgggggcccaaggtgggagaatcagttgattccaggaattcgaggccagcctgggcaacatagggagatcccatctctacaaaaaaaatacatatttttttgaaacagagtcgcactccatttgcccaggctggagtgtcgctgcagtgagctgtaatcgcacaatgagccgagattgtgccacagcactccagtggtgacagagtgagaccctgtctcaaaaaaaaaagaagaaa

SEQ ID NO: 449570 - DNA, 2629 bp, Homo sapiens
aagggaattcgtgctggtgcaagggcattcgtgctggtgctagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 449571 - DNA, 1452 bp, Homo sapiens
ggcgggggcgcgccagccggcccggcgggcgcgcgacggcggccgccggggccgccgacgcggccgccggcaccaggacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 449572 - DNA, 413 bp, Homo sapiens
aaaacgcgtgcttttgtgcgacacctcccgaaccccagagccatatcgtgccttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 449573 - DNA, 1750 bp, Homo sapiens
agaagcccagtagacaaagaaggtaagggcagtgagaatgatgcatcttgcattccttgtgctgttgtgtctgccagtctgctctgcctatcctctgagtggggcagcaaaagaggaggactccaacaaggatcttgcccagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggattgtgaattatacaccagatttgccaagagatgctgttgattctgccattgagaaagctctgaaagtctgggaagaggtgactccactcacattctccaggctgtatgaaggagaggctgatataatgatctcttttgcagttaaagaacatggagacttttactcttttgatggcccaggacacagtttggctcatgcctacccacctggacctgggctttatggagatattcactttgatgatgatgaaaaatggacagaagatgcatcaggcaccaatttattcctcgttgctgctcatgaacttggccactccctggggctctttcactcagccaacactgaagctttgatgtacccactctacaactcattcacagagctcgcccagttccgcctttcgcaagatgatgtgaatggcattcagtctctctacggacctccccctgcctctactgaggaacccctggtgcccacaaaatctgttccttcgggatctgagatgccagccaagtgtgatcctgctttgtccttcgatgccatcagcactctgaggggagaatatctgttctttaaagacagatatttttggcgaagatcccactggaaccctgaacctgaatttcatttgatttctgcattttggccctctcttccatcatatttggatgctgcatatgaagttaacagcagggacaccgtttttatttttaaaggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggagatttgatgaaaatagccagtccatggagcaaggcttccctagactaatagctgatgactttccaggagttgagcctaaggttgatgctgtattacaggcatttggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcc

SEQ ID NO: 449574 - DNA, 909 bp, Homo sapiens
tcggctgtatctagaggaccccgatgagtaaatctggcgggatctgagatgccagccaagtgtgatcctgctttgtccttcgatgccatcagcactctgaggggagaatatctgttctttaaagacagatatttttggcgaagatcccactggaaccctgaacctgaatttcatttgatttctgcattttggccctctcttccatcatatttggatgctgcatatgaagttaacagcagggacaccgtttttatttttaaaggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggagatttgatgaaaatagccagtccatggagcaaggcttccctagactaatagctgatgactttccaggagttgagcctaaggttgatgctgtattacaggcatttggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcc

SEQ ID NO: 449575 - DNA, 258 bp, Homo sapiens
tggctgtgaactggacattattaggttggaattaaaaccaagccttcctctttaccacaacaatgcactataattatttttaaaatcaatggcttcaagtaaaatgtcttggatttattttttcaataggaaatgagttctgggccatcagaggaaatgaggtacaagcaggttatccaagaggcatccataccctgggttttcctccaaccataaggaaaattgatgcagctgtttctgacaaggaaaagaagaaaa

SEQ ID NO: 449576 - DNA, 1570 bp, Homo sapiens
ccggctccgaccccgaggccgaaggccttccaggtcacctgagagtctccgcccaatggggcggccctggccagaagcggaggaggtggcacccgggaccgagctggggtcttggaggaagagaggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcggggtgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttcaaaaaaaaaaaatt

SEQ ID NO: 449577 - DNA, 1678 bp, Homo sapiens
  misc_feature (1504)..(1504): n is a, c, g, or t
ccggctccgaccccgaggccgaaggccttccaggtcacctgagagtctccgcccaatggggcggccctggccagaagcggaggaggtggcacccgggaccgagctggggtcttggaggaagagaggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcggggtgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggtatcccccagggagtaggggctaccttgaggggatgatagacctcccccactcccagtgggactctggaaatatgaaggaactagggagtggaagagatttcagagctggggagaggagttcctcccttcaaagccagcaactgcctttagtgagggttaattcgcgaattaaccctcactaaggtgctggaattacaggtgtgagccaccgtgcccgccaagtatctcttttctacagccttattaaactaactacnaacatttattttccaatttagttttactttcagtgcatatcaaagttgttgtactcttcagaccaacaaattaacttgagggcaaattacatagctttccatgtacccttttttcctcaggtgctaatcaaaggctctaaaagggatcctctagagcgacagcaggcagcaaag

SEQ ID NO: 449578 - DNA, 2117 bp, Homo sapiens
ccggctccgaccccgaggccgaaggccttccaggtcacctgagagtctccgcccaatggggcggccctggccagaagcggaggaggtggcacccgggaccgagctggggtcttggaggaagagaggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggtgcagaccctgcccttcctcatctgcctgacacaccagaaatctaggggctgagttttgacctgggcccatccatccctcccccagcctggttcacaggggcctcctcctctctgcagactttgcccttgtgccttcgtgaagaaggctgcagcagcagccacctttgggcctctcctggcccagaaatagagcagtggttatttatttattttcagttgaaatcttacatagagtcccaatttataaaaccagtaatagtggatggagcagctctgggtggagagaggttaggggctcaggacacttctctctctgaaactgtgtttcaggccttttcatggaaccctcaaagcatagcacatggaaccagagcattgaaagccactggcataattgcatttgatacgatcagtgccagcagatttgctgtgtgacttgggcctatcaccaaacctctccgggcctcttctgtcccctggagcttctgccaccagccattgatccctctgtcacccttctgtcccttggccctctcttttgccaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcggggtgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttcaaaaaaaaaaaatt

SEQ ID NO: 449579 - DNA, 2481 bp, Homo sapiens
ccggctccgaccccgaggccgaaggccttccaggtcacctgagagtctccgcccaatggggcggccctggccagaagcggaggaggtggcacccgggaccgagctggggtcttggaggaagagagggtgaggggaatacagtactgggggtgagagaagggttggacagaagagggtcgggtatctgggcatgcgcagggccgcaggactcttggtggggtagcgagggggacggtcccacgactgctccgaagggccgggactcccagtgggggcgggacccccggagtgcccgcctgcggactcccaagcctggagcctggggagagggtgggcacctccgttcccgcacacccgtccatggtgtgtgcgccgagcgtccaggagccacggcggtgtcttccttgcgcgtcttttacacgtgtgggggtaggctgctcctcggggctgagccgtggccagggttatggagaggcccgcctctccccagatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggtgcagaccctgcccttcctcatctgcctgacacaccagaaatctaggggctgagttttgacctgggcccatccatccctcccccagcctggttcacaggggcctcctcctctctgcagactttgcccttgtgccttcgtgaagaaggctgcagcagcagccacctttgggcctctcctggcccagaaatagagcagtggttatttatttattttcagttgaaatcttacatagagtcccaatttataaaaccagtaatagtggatggagcagctctgggtggagagaggttaggggctcaggacacttctctctctgaaactgtgtttcaggccttttcatggaaccctcaaagcatagcacatggaaccagagcattgaaagccactggcataattgcatttgatacgatcagtgccagcagatttgctgtgtgacttgggcctatcaccaaacctctccgggcctcttctgtcccctggagcttctgccaccagccattgatccctctgtcacccttctgtcccttggccctctcttttgccaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcggggtgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttcaaaaaaaaaaaatt

SEQ ID NO: 449580 - DNA, 1894 bp, Homo sapiens
ccggctccgaccccgaggccgaaggccttccaggtcacctgagagtctccgcccaatggggcggccctggccagaagcggaggaggtggcacccgggaccgagctggggtcttggaggaagagagggtgaggggaatacagtactgggggtgagagaagggttggacagaagagggtcgggtatctgggcatgcgcagggccgcaggactcttggtggggtagcgagggggacggtcccacgactgctccgaagggccgggactcccagtgggggcgggacccccggagtgcccgcctgcggactcccaagcctggagcctggggagagggtgggcacctccgttcccgcacacccgtccatggtgtgtgcgccgagcgtccaggagccacggcggtgtcttccttgcgcgtcttttacacgtgtgggggtaggctgctcctcggggctgagccgtggccagggttatggagaggcccgcctctccccagatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcggggtgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttcaaaaaaaaaaaatt

SEQ ID NO: 449581 - DNA, 1062 bp, Homo sapiens
gggtctgggaggaagagaggatggcgtcgtcgagccctgactccccatgttcctgcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcggggtgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttcaaaaaaaaaaaatt

SEQ ID NO: 449582 - DNA, 506 bp, Homo sapiens
acatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaaggttagtgaacggtggagggggctgggggccaggagggccacagcagtgccagccactctcccctcccacagcttccccctctactccttggcagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtgggaagaatgagggtggggaaggctggggagaagagagga

SEQ ID NO: 449583 - DNA, 1837 bp, Homo sapiens
ccggctccgaccccgaggccgaaggccttccaggtcacctgagagtctccgcccaatggggcggccctggccagaagcggaggaggtggcacccgggaccgagctggggtcttggaggaagagaggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcggggtgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggtatcccccagggagtaggggctaccttgaggggatgatagacctcccccactcccagtgggactctggaaatatgaaggaactagggagtggaagagatttcagagctggggagaggagttcctcccttcaaagccagcaactgcctttggggaatgtcggggggtatctcctttctcctgcttgtgtgaggtggtacacagtccccccttcacctggcgggaagcctgtcccggacagactcatctcagctttcccttggggcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttcaaaaaaaaaaaatt

SEQ ID NO: 449584 - DNA, 1934 bp, Homo sapiens
ccggctccgaccccgaggccgaaggccttccaggtcacctgagagtctccgcccaatggggcggccctggccagaagcggaggaggtggcacccgggaccgagctggggtcttggaggaagagagggtgaggggaatacagtactgggggtgagagaagggttggacagaagagggtcgggtatctgggcatgcgcagggccgcaggactcttggtggggtagcgagggggacggtcccacgactgctccgaagggccgggactcccagtgggggcgggacccccggagtgcccgcctgcggactcccaagcctggagcctggggagagggtgggcacctccgttcccgcacacccgtccatggtgtgtgcgccgagcgtccaggagccacggcggtgtcttccttgcgcgtcttttacacgtgtgggggtaggctgctcctcggggctgagccgtggccagggttatggagaggcccgcctctccccagatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcggggtgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttcaaaaaaaaaaaatt

SEQ ID NO: 449585 - DNA, 1388 bp, Homo sapiens
ccggctccgaccccgaggccgaaggccttccaggtcacctgagagtctccgcccaatggggcggccctggccagaagcggaggaggtggcacccgggaccgagctggggtcttggaggaagagaggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcggggtgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttcaaaaaaaaaaaatt

SEQ ID NO: 449586 - DNA, 2140 bp, Homo sapiens
ccggctccgaccccgaggccgaaggccttccaggtcacctgagagtctccgcccaatggggcggccctggccagaagcggaggaggtggcacccgggaccgagctggggtcttggaggaagagagggtgaggggaatacagtactggggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggtgcagaccctgcccttcctcatctgcctgacacaccagaaatctaggggctgagttttgacctgggcccatccatccctcccccagcctggttcacaggggcctcctcctctctgcagactttgcccttgtgccttcgtgaagaaggctgcagcagcagccacctttgggcctctcctggcccagaaatagagcagtggttatttatttattttcagttgaaatcttacatagagtcccaatttataaaaccagtaatagtggatggagcagctctgggtggagagaggttaggggctcaggacacttctctctctgaaactgtgtttcaggccttttcatggaaccctcaaagcatagcacatggaaccagagcattgaaagccactggcataattgcatttgatacgatcagtgccagcagatttgctgtgtgacttgggcctatcaccaaacctctccgggcctcttctgtcccctggagcttctgccaccagccattgatccctctgtcacccttctgtcccttggccctctcttttgccaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcggggtgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttcaaaaaaaaaaaatt

SEQ ID NO: 449587 - DNA, 1014 bp, Homo sapiens
aataggctagtagagctcgcgttaatcggacgaggcacaggcttatgttagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcggggtgggggtggcccaggccccccaggtgctgtcccccacttttggagcacaagaccctgttcggaccctgccccgattccagactcaggtagagatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttcaaaaaaaaaaaatt

SEQ ID NO: 449588 - DNA, 951 bp, Homo sapiens
agcgggtctggttcaggggctagaaaagagcgtcgatgccggcggcagtgatgagtcctaggaggcgctggctctttggcggctcggaggagcggctgctgctgctgctgctgctgctggtggcccctttgcagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtaccagctttatataccacttattagaggttgccaagtgtgatatctaggccttaatctagaaattaagctaatgaggccctatttacacaatagactcctctatccccctttgtcacttcagatttaagaattgtcttgttctataaatcaga

SEQ ID NO: 449589 - DNA, 1791 bp, Homo sapiens
agcgggtctggttcaggggctagaaaagagcgtcgatgccggcggcagtgatgagtcctaggaggcgctggctctttggcggctcggaggagcggctgctgctgctgctgctgctgctggtggcccctttgcagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaattgggcgatagctcaggggatccatagagtc

SEQ ID NO: 449590 - DNA, 1715 bp, Homo sapiens
  misc_feature (2)..(2): n is a, c, g, or t
  misc_feature (88)..(88): n is a, c, g, or t
ancatagaacagttgacaaaaagcggcggtaccgtcggaattcccggatcgaggagcgcgcgcgcgctgcgcgcggtggcccctttgngatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaa

SEQ ID NO: 449591 - DNA, 1849 bp, Homo sapiens
agcgggtctggttcaggggctagaaaagagcgtcgatgccggcggcagtgatgagtcctaggaggcgctggctctttggcggctcggaggagcggctgctgctgctgctgctgctgctggtggcccctttgcagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattggttgtttatttttgactggtacgtattgttaaataagtcgatataagggtgaatggaaaaaaaaggggggctaaagtaccgaggcgttgggcgtttgaaggcgaggggataagaggggggggtaagggggagggcggttgggcctggggggagcccaacgaaattggtgtcgggttataaaa

SEQ ID NO: 449592 - DNA, 1117 bp, Homo sapiens
gcttccaggaattatagctggaatccctcagtacctgcatgtttcaggcacacagttaaatgggattaaagtgcagttatataattaaacagaacttcctcctgagttgtgttttaacacctggtctcttcctgtcctgatcaacaggtatctgtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaa

SEQ ID NO: 449593 - DNA, 1026 bp, Homo sapiens
aactacccaacacccgcatccagtgttcaccccaccgcgcccgccatccccggtctatataggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaa

SEQ ID NO: 449594 - DNA, 1380 bp, Homo sapiens
agcgggtctggttcaggggctagaaaagagcgtcgatgccggcggcagtgatgagtcctaggaggcgctggctctttggcggctcggaggagcggctgctgctgctgctgctgctgctggtggcccctttgcagaaaagttctaagaacagtgctgttggctcagtgagatgaggttatcggaaaactttctgtttacacaagagttgcctccttcaaagaagcatgcatggtccttgcaggtcactgtgcccatcactctgcatagtccagctgcactctgcttcacacagctgcctgcccattgcaggcatttgagtttgcaatccatgccttaaactttaaatcacactggctacagcgttgtgtgtttcttggtaaacactgggtaaatcagctcctgtggatgttgactgaagtttctatgtttgcaagctaatcctcagcagtttctttatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaa

SEQ ID NO: 449595 - DNA, 574 bp, Homo sapiens
cacgttttcattttttttttaattggaagatctagaaacctcagttgctcagtatcacagggcatgggctggagctaagtagtaggtactcctttgattttttacatgaatttttaggaggttttgaaatgattgttttagcttttttaaaaaagacatttatttactcaaagtttctctgtggtctgactctaagtcttgcattcatcctagtcttcgatgtcagcaatcccatcttctttttgttttccagaaaagttctaagaacagtgctgttggctcagtgagatgaggttatcggaaaactttctgtttacacaagagttgcctccttcaaagaagcatgcatggtccttgcaggtcactgtgcccatcactctgcatagtccagctgcactctgcttcacacagctgcctgcccattgcaggcatttgagtttgcaatccatgccttaaactttaaatcacactggctacagcgttgtgtgtttcttggtaaacactgggtaaatcagctcctgtggatgttgactgaagtttctatgtttgcaagctaatcctcagcagtttcttt

SEQ ID NO: 449596 - DNA, 1760 bp, Homo sapiens
agcgggtctggttcaggggctagaaaagagcgtcgatgccggcggcagtgatgagtcctaggaggcgctggctctttggcggctcggaggagcggctgctgctgctgctgctgctgctggtggcccctttgcagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaa

SEQ ID NO: 449597 - DNA, 1899 bp, Homo sapiens
  misc_feature (1775)..(1775): n is a, c, g, or t
  misc_feature (1782)..(1782): n is a, c, g, or t
  misc_feature (1786)..(1787): n is a, c, g, or t
  misc_feature (1812)..(1812): n is a, c, g, or t
  misc_feature (1870)..(1870): n is a, c, g, or t
  misc_feature (1888)..(1888): n is a, c, g, or t
agcgggtctggttcaggggctagaaaagagcgtcgatgccggcggcagtgatgagtcctaggaggcgctggctctttggcggctcggaggagcggctgctgctgctgctgctgctgctggtggcccctttgcagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaaaaaaaaaaaaaaaanaaaaaanaaannaaaaattttttatttataaaatttntttttttaatattattttttattttttatttttaatattttttttttataatttattntttttattaatttttttnttaaatctcgg

SEQ ID NO: 449598 - DNA, 2081 bp, Homo sapiens
agcgggtctggttcaggggctagaaaagagcgtcgatgccggcggcagtgatgagtcctaggaggcgctggctctttggcggctcggaggagcggctgctgctgctgctgctgctgctggtggcccctttgcagaaaagttctaagaacagtgctgttggctcagtgagatgaggttatcggaaaactttctgtttacacaagagttgcctccttcaaagaagcatgcatggtccttgcaggtcactgtgcccatcactctgcatagtccagctgcactctgcttcacacagctgcctgcccattgcaggcatttgagtttgcaatccatgccttaaactttaaatcacactggctacagcgttgtgtgtttcttggtaaacactgggtaaatcagctcctgtggatgttgactgaagtttctatgtttgcaagctaatcctcagcagtttctttatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaa

SEQ ID NO: 449599 - DNA, 1772 bp, Homo sapiens
  misc_feature (1178)..(1178): n is a, c, g, or t
  misc_feature (1184)..(1184): n is a, c, g, or t
  misc_feature (1229)..(1229): n is a, c, g, or t
  misc_feature (1240)..(1240): n is a, c, g, or t
agcgggtctggttcaggggctagaaaagagcgtcgatgccggcggcagtgatgagtcctaggaggcgctggctctttggcggctcggaggagcggctgctgctgctgctgctgctgctggtggcccctttgcagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagcnaaaaanaataaacaaaaaaaaaaaaaaaaaaaaaaaagataaacaaagaanaaaaaaaaaanaaagaaaaataagatttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaa

SEQ ID NO: 449600 - DNA, 1034 bp, Homo sapiens
ctgaactgaagtaaacatataaagtatgcgaacaacaccccccgcttcggtgtctcagtagagatttatcgtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaa

SEQ ID NO: 449601 - DNA, 177 bp, Homo sapiens
aatctgatcatggagttaattttactgtattgcaagattttaagatgagctggtgttctcttgttatgcccatatgccatcattccctcccccctcacccagaatgtgaatagtattcccattgtgggaactgctgattgacatcaaggcactctgttgtcatggctctagtttaaa

SEQ ID NO: 449602 - DNA, 902 bp, Homo sapiens
gcaacattcactgtctttccctaaaggggtgttaatcaccattttttattccaagtaaggaaaataaagccaaggttaaaaattaaaattgttggtctctgtattaggcctgagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449603 - DNA, 1522 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449604 - DNA, 1846 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449605 - DNA, 1145 bp, Homo sapiens
ggggggggggctagctgcaacgactctcttaatctccaccgctacacaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449606 - DNA, 1408 bp, Homo sapiens
aggtcccgcccctgtgggcggggcgaggcagcgtcgccgcgaggccacccggaagaccaagccgggtaggcgctgtctccgtcgcctccaacccccccggtccgaccagggaagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449607 - DNA, 1187 bp, Homo sapiens
  misc_feature (50)..(50): n is a, c, g, or t
taattgctagagttgcggtacatctgattagtgtaggaaaaagggagggnctagtcgttgactgactctcttaattaccaccgctacagaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449608 - DNA, 1177 bp, Homo sapiens
  misc_feature (35)..(35): n is a, c, g, or t
  misc_feature (75)..(76): n is a, c, g, or t
gtacattataagccagacgattagaaaaaaaaagnaaagttttaacggcactgactctcttccttaaccgccgcnncagaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449609 - DNA, 1369 bp, Homo sapiens
ggaagcgtggctcatgctcggctagtctgtatgctagtagcggatgcggtgctgtgtgttggtcaggctgttcctgttcgtggaggagctcgtggacggggttggccaatggcgaaaaactgtagtgcaggactcagatgcaataaatcctcttttggggcacgaaaacgaagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449610 - DNA, 1890 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgaagatcggccgttctccttctaaatataacaaaatcacacaataa

SEQ ID NO: 449611 - DNA, 2014 bp, Homo sapiens
  misc_feature (2009)..(2010): n is a, c, g, or t
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgatgaatggacaactcctgggtgcctcttagattgcttgaaaatgcccatgtagtgtgatatgcagcatttcagcctatggggtgatataatagcagctaataggctttattctgcaagcaatcaaataataaatctattctgctaagaggtcaaaaaaaaaagnnaaaa

SEQ ID NO: 449612 - DNA, 1905 bp, Homo sapiens
  misc_feature (1870)..(1870): n is a, c, g, or t
  misc_feature (1874)..(1874): n is a, c, g, or t
  misc_feature (1876)..(1876): n is a, c, g, or t
  misc_feature (1880)..(1880): n is a, c, g, or t
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgagagtatgcgcgccagctccccccncccntntttnttttatttaattcccaccgttacct

SEQ ID NO: 449613 - DNA, 2113 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgaaaaaaaaaaaaaaaaaaaaaatttgtgggcggccttgggcccttggaaaaagtttttaagacaattggtgtgggggggggggccagtgggtaggtgaaactgggtcatagctgtgccctaagagagaatctggctccatgactagtagcttgggttttctcagccaattaaaaaaggccggggggaacccgaggttttgaacaattccagagggagttcggaggcataaggggatctataacaggattcaagcgagtcgatttcatg

SEQ ID NO: 449614 - DNA, 1910 bp, Homo sapiens
  misc_feature (1878)..(1878): n is a, c, g, or t
  misc_feature (1888)..(1888): n is a, c, g, or t
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgataggtatgcgtgccagctctccttgttttgtntctgctccgnttgtggcattcctgcctcttct

SEQ ID NO: 449615 - DNA, 1898 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgacagtatgcgaccacttttttccttgtccctctgtacctacaaataatctaca

SEQ ID NO: 449616 - DNA, 1888 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgaaatctcatcttccctaccttcaacaaattccactcatcaact

SEQ ID NO: 449617 - DNA, 1899 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgatagatggcgcccgaaaattttcttctttttttccgtttttgttacaaataaaa

SEQ ID NO: 449618 - DNA, 1902 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgacaggcatcgcgccgttttttttaaatactactctcaccacagaccgtccgctctca

SEQ ID NO: 449619 - DNA, 1893 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgacgtccgctcccctttacgaaaatttatataacatataaacaatgact

SEQ ID NO: 449620 - DNA, 1708 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcgggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449621 - DNA, 1520 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcagtaaaaaaaaaaagtttttggcccccctttttccaacctataaaaaaaaattttgggggggggggaaaaaaaaaaaagaaattttttgtggtaaaccccccccctaaacaccttggttaaaaaacaacgggggggggggggctttttaaaaaatgtttgtaagaaaggcccccccccccaataaaccttttaggcgcggaaaaagggctttggttttaaaatttgaaccattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449622 - DNA, 1811 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttctgataaatcaagcaattttttatatctacaagttaagggagaagtagaagccaaggttgaagaattaaaatttgatcgttaagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449623 - DNA, 1110 bp, Homo sapiens
ggggggggggctagctgcaacgactctcttaatctccaccgctacacaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttctgataaatcaagcaattttttatatctacaagttaagggagaagtagaagccaaggttgaagaattaaaatttgatcgttaagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449624 - DNA, 823 bp, Homo sapiens
cgggcccccctcgagccgagggttcgatagcttatccagtagtatgtgatggtaaaaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449625 - DNA, 1399 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcgcggtaaggaaggcatatgctcttttccctttttgctggccagtaatatcaaggattcttttcttgctcactctttttctttgtgcctgttgcaatgcttaaatgtgaataagcctttattgtttaagattctatatgctgcactaacctttggtatccttttaatagtactgataagttcgtctttcaaagtaatccttgagttcaggccccagtgctggagacgtcgtaaatatttacatgattttgcctattgtgattatcgctatcactacatcccctgactaagggaaaccatgatgtctgagtaaaactaattggtttatgctgttaacaatcagctgtttttccccttaataaatgtttgaaatttgaaaaaaaaaaaaaaaaaaaaaaaaaaaaaaaaaaaaaaacaaacaaaaaacagaaaaaaaaaacacgaaaaaaacaaacaaaaaaacaagcaacaagaacgcacaacaaagacaaagaacaacaacaggacaacaaagaaacacaacacaagagagacgacgccccgcacaaacaacagccaggcacaaggggcggcggccccaaccaaacacccacacgcgcggacgccggcccacagtatccaaactccacgatgtgtggtgtagacccacaggcgacaactgcctcgactgtggttctaatcaaaacacggacgagaggggcgctgctagacaactctgcaaccggaggggaacagcaccaagcactgcccgccgtgtgcagtcacgaacgcaccaactcgttggtggcggtagacatgccgaccgaccacaacgacgaccgacgctcacggcgcccagtgagaacacacactagcgggtcgttgtcgagc

SEQ ID NO: 449626 - DNA, 1565 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcgcggtaaggaaggcatatgctcttttccctttttgctggccagtaatatcaaggattcttttcttgctcactctttttctttgtgcctgttgcaatgcttaaatgtgaataagcctttattgtttaagattctatatgctgcactaacctttggtatccttttaatagtactgataagttcgtctttcaaagtaatccttgagttcaggccccagtgctggagacgtcgtaaatatttacatgattttgcctattgtgattatcgctatcactacatcccctgactaagggaaaccatgatgtctgagtaaaactaattggtttatgctgttaacaatcagctgtttttccccttaataaatgtttgaaatttgaaatgttctgtctcacttgagtgatttgcttcaacttattttcatgtcaagctttaaacttctggaatagaacatcagaacacaggcacgattcaaccagcctccagcgatgactcagccttcagcgatgattcaaccccactaatgattcagtctttactgacgcaaaagtcttttaacgcacattttattttctttttaatggtgttctaaattgagtcagctcctgtacagaagtcatagtttactacatagttagaaatcagagtttactacctggattctgggcaaatgttagtgcgggtacatcttatttaatttatactttgactatag

SEQ ID NO: 449627 - DNA, 864 bp, Homo sapiens
aggtcccgcccctgtgggcggggcgaggcagcgtcgccgcgaggccacccggaagaccaagccggcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcgcggtaaggaaggcatatgctcttttccctttttgctggccagtaatatcaaggattcttttcttgctcactctttttctttgtgcctgttgcaatgcttaaatgtgaataagcctttattgtttaagattctatatgctgcactaacctttggtatccttttaatagtactgataagttcgtctttcaaagtaatccttgagttcaggccccagtgctggagacgtcgtaaatatttacatgattttgcctattgtgattatcgctatcactacatcccctgactaagggaaaccatgatgtctgagtaaaactaattggtttatgctgttaacaatcagctgtttccttataaggttaaaacaaaaaaaaaaaaagttgggggccggcccgaaatttaaccactggggggccggaagaaggcagccggacggaaggggtcccaaacggggcggggaccgggtggtgttacgcccatcccccgcgggaaagaaag

SEQ ID NO: 449628 - DNA, 1359 bp, Homo sapiens
aggtcccgcccctgtgggcggggcgaggcagcgtcgccgcgaggccacccggaagaccaagccggcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449629 - DNA, 1176 bp, Homo sapiens
atgttatatcatattttatctgtgtgtacggggagggggttttatctgcaacgactctcttaattaccaccgctacagaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449630 - DNA, 1176 bp, Homo sapiens
cgatgctaatttataggcgcgaaatatagagggagggggaagctatctgcaagactctcttatcctccaccgctacacaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449631 - DNA, 1900 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgaatgatgcgtctcactctttttttttctcacctttacaacacaagtcaatataaa

SEQ ID NO: 449632 - DNA, 1893 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgacggccagctctcttctctcttcgtcataatgtgggtagatatcacaa

SEQ ID NO: 449633 - DNA, 1894 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgatcccgatgcggcagacttatctattgggaacagacacatacaatataa

SEQ ID NO: 449634 - DNA, 1896 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgagcgatgcgcgccgtcccccccctcactctccacccaccgagtgtgcggag

SEQ ID NO: 449635 - DNA, 1910 bp, Homo sapiens
  misc_feature (1859)..(1859): n is a, c, g, or t
  misc_feature (1867)..(1867): n is a, c, g, or t
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgagcggatgcggccngaatccanccattctgacgaaacacaaatgacttccacgcaccgaccgcgc

SEQ ID NO: 449636 - DNA, 1917 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgacaacgtagatcgcggccggccccccaccgcccgccattcccaaacacccactggcgaatgtgcgggctacc

SEQ ID NO: 449637 - DNA, 1872 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgagcttgttttgtcctgtgacttttttg

SEQ ID NO: 449638 - DNA, 1384 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcgggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449639 - DNA, 1504 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttaagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449640 - DNA, 1241 bp, Homo sapiens
aggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcgcggtaaggaaggcatatgctcttttccctttttgctggccagtaatatcaaggattcttttcttgctcactctttttctttgtgcctgttgcaatgcttaaatgtgaataagcctttattgtttaagattctatatgctgcactaacctttggtatccttttaatagtactgataagttcgtctttcaaagtaatccttgagttcaggccccagtgctggagacgtcgtaaatatttacatgattttgcctattgtgattatcgctatcactacatcccctgactaagggaaaccatgatgtctgagtaaaactaattggtttatgctgttaacaatcagctgtttttccccttaataaatgtttgaaatttgaaatgttctgtctcacttgagtgatttgcttcaacttattttcatgtcaagctttaaacttctggaatagaacatcagaacacaggcacgattcaaccagcctccagcgatgactcagccttcagcgatgattcaaccccactaatgattcagtctttactgacgcaaaagtcttttaacgcacattttattttctttttaatggtgttctaaattgagtcagctcctgtacagaagtcatagtttactacatagttagaaatcagagtttactacctggattctgggcaaatgttagtgcgggtacatcttatttaatttatactttgactatag

SEQ ID NO: 449641 - DNA, 825 bp, Homo sapiens
agctcggtaccgtcagacgctgaactatgtggagaaaaaggaacttacactgctggtgggaatgtaaattagggtagtcattgtggaaaacagtatggagatttctcaaaaaactaagaagagaactatcatatccaacagtcctactactatttacccaaagacaaaaaatcagtatatcaaagagacaacctgcactcccatctcccatgtttactgcagcacaattcacaagagcaaagatatggaatgcacttaagtgtccaccaatggatgagtggataaagaaaatgtagtatatatagatgcagtgaaatactatcaggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatga

SEQ ID NO: 449642 - DNA, 906 bp, Homo sapiens
  misc_feature (50)..(50): n is a, c, g, or t
taattgctagagttgcggtacatctgattagtgtaggaaaaagggagggnctagtcgttgactgactctcttaattaccaccgctacagaatcaagaagtggtggactttgaaaagttggatgactacgcctctgcctttcaaggtcatgatgttggattctgttgcctgggtaccaccagagggaaagctggggcgcggtaaggaaggcatatgctcttttccctttttgctggccagtaatatcaaggattcttttcttgctcactctttttctttgtgcctgttgcaatgcttaaatgtgaataagcctttattgtttaagattctatatgctgcactaacctttggtatccttttaatagtactgataagttcgtctttcaaagtaatccttgagttcaggccccagtgctggagacgtcgtaaatatttacatgattttgcctattgtgattatcgctatcactacatcccctgactaagggaaaccatgatgtctgagtaaaactaattggtttatgctgttaacaatcagctgtttttccccttaataaatgtttgaaatttgaaatgttctgtctcacttgagtgatttgcttcaacttattttcatgtcaagctttaaacttctggaatagaacatcagaacacaggcacgattcaaccagcctccagcgatgactcagccttcagcgatgattcaaccccactaatgattcagtctttactgacgcaaaagtcttttaacgcacattttattttctttttaatggtgttctaaattgagtcagctcctgtacagaagtcatagtttactacatagttagaaatcagagtttactacctggattctgggcaaatgttagtgcgggtacatcttatttaatttatactttgactatag

SEQ ID NO: 449643 - DNA, 7117 bp, Homo sapiens
  misc_feature (5786)..(5786): n is a, c, g, or t
tccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacancccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaa

SEQ ID NO: 449644 - DNA, 2592 bp, Homo sapiens
  misc_feature (1250)..(1250): n is a, c, g, or t
tgagattgaacatctaatctcatagttgccaagacagtctctggtgtaaaagaaaataccaagcaatagtccttaactttgaagctgtcatggttagcatatattagtatttctagactcagattttagtttaaatttatgtctgtgctatagttacaggatgatttagcaaaattgcccgcaattaggtcatgtgtaacctagtggttagggtgttacttatgatagtcgtgatagccattctaaccctgcttatactgtctgagtgattagcacttcattggtatagtttattttatggctgtataaaagtactttcagcctttttcaagttatgtcacacagaaaatttcgtttttctaggactgtaaatggatgaggcagctgttaactggctataggctctgtcattcctgagggctgagtcaatcaatatttccacccatctataaaccactgttgcacattagtgtgccagtgcacattctttgagaaattgtggatgtatggtatataaggccattcaactactcaaatattaaatgctcaagttaatattctgaggctcttaatcaagagtcttgagggttagacaaatagtagaaactaaggaatcattttcaattgaagttagcatgatattaaatatctttgcctatattggataatgtgcaaactgattcatgaaactaaatttaataatactatttttctatttgaaaaaaatggccaagtatacagtatgataaacttaattgattttcttggtttaccaaataatctttgtgaatttatgagtaaaccagccaacagattatttaaaaaatatttttaagaatatggccgtgaacattttactattttgctttgtcatgggagtaatgaggaaaagccctatgcttcaactccctagtccttaggaccccatattgatttggtgagggggctgctgggacaggaagaattttgctagtgttttatatgaactgcattagaagaagctccactcctgaagatgtcagtggacagatttgcctcttctcttctttcccttggacccagagcctgcttctattgccaggaggggagccaggaaaagagctggacttggccaagtgattaggggagtatgagaggaggagtaggaggctctgagattgagctgaaaatgaggaattaaatcaccctatgtaaagatcaccttacacaatggtcactttactctgttctttacagaaggctgtcacggntgtgtaccttgaatgggaactttggactgccattgttggtagatacagtagctaggtgtttaacttttaggcagaaatatcttgaggaattggaaggcagagttacagacaatgctggtatgtggaatactgtaaaaccatcaggttgggttcgtttatactgttgtttacattgttactgcatgtacataatgatctctatagcaaagaaatttataagatgatgatagttttgtctcctttcccaaaattatcatgaagccactgttctgttttgtcttttattagtgtaagttaagagattttgctttagtggtatttttagacttgtcaatagatttgttcttctttgatttggttttgcagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaagtaagtgtctggtcttgattggcttttaaatttgatattacttatattagtataagcaatttgctacttgggttgattgaccattaatgctgaatttactataaaacatattgttcactattgtaaaatggtaaagggtatgtaattcttaaaataattttctttgtgttgtttgttcctcattcttaattgtgatatgatttataatcattttcacattcctttagagagttttacataacataaggcagaaatatttacaaataaatttagtgataaaaattgcatggtgacactaacatttgtaagtgattagtgtggatcttgtgctagctgtgttgaatggctaatgcacttcaagatatttcaatgggccaggtgtagtggccacacctataatcccagcactttgggaggccgaggcaggctagtcgcttgagcccaagagtttgagaccagtctgggcaacatgcgaaaccccatctctaccaaaaatacaaaaattagctgggtatgttagtgcatgcctgtagctccagctacttgggggctgaggtgggaagatcgcttgagcccaggaggtcaagactgcagtgaactgagatagcaccactacactccagcgtaggtgacagagtgacaccctgtctc

SEQ ID NO: 449645 - DNA, 706 bp, Homo sapiens
attgtgaagtttcaaaggtagaatggttctgactgaagaccagttgcaaggaattgccatgtttgagggttgtacaggagagtagaactaattatttacccctataatggacttctaaattggttaattgcattggcttagtctctaaaggataggtaaaagctgtatctgagggacactgcctagccatgtatagtgctcctactgttatgatgtcgttttttccatgggaggaggatgttcttgtttttgtagttattggaaattttgaaagtatgtgggattggccctaatggtgaaactaatgttcctctttgtttttagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggtaaaccaaaatctggtgggatatttattttataggatgaataaggattttaatctgttttgtaaaagtaggttgtggtgtcttagccaacagattgttgtgagaagtattcatacacatgaatcttgacgataatgtgttaatttgaagctcaggatatcatcagtatcatgactatctttctgtgtagaacggggccctgtgaaaatgaa

SEQ ID NO: 449646 - DNA, 948 bp, Homo sapiens
attgtgaagtttcaaaggtagaatggttctgactgaagaccagttgcaaggaattgccatgtttgagggttgtacaggagagtagaactaattatttacccctataatggacttctaaattggttaattgcattggcttagtctctaaaggataggtaaaagctgtatctgagggacactgcctagccatgtatagtgctcctactgttatgatgtcgttttttccatgggaggaggatgttcttgtttttgtagttattggaaattttgaaagtatgtgggattggccctaatggtgaaactaatgttcctctttgtttttagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaaggtaaggagctccccctttctcctcttctcatggaatggtctgaaatattttaatagatacgtaagctatcactagttaatgctcctgattggaagacgtgctccatattttacataaatctctttattcttcagagtggtttcttttaaagatgcttttgtagggagatggttaaagagaaggggacaggtattatatagtaggcctatgacatttttgaggcttaaatcctgaatttgtagtgaattctcaaaattaagatgtcacgaatgcatgggatctctggaattgtcacaagtattttcattttgttttctttta

SEQ ID NO: 449647 - DNA, 640 bp, Homo sapiens
tccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgacggacacattaattactgggattcagagacgggggagtaacgactccttcgctgggaaaggccacacgaaccaggtgtccagatgaccgtgtatgagtcggggcagctcatcagctgcagcatggacgacaccgtcggtacaccacctcatgctgcgggactacagcggacaaggagtgtgaaactgacgtcagcaagtgcg

SEQ ID NO: 449648 - DNA, 6894 bp, Homo sapiens
  misc_feature (5786)..(5786): n is a, c, g, or t
tccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacancccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaattgagtagtgaatgctacactcattttcaactctttaacatgaaactgttcaatcttaacacattgttactttaatatatgtataaagaagtattactgtttgtaaagctgctgtttgcttaaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaa

SEQ ID NO: 449649 - DNA, 7493 bp, Homo sapiens
  misc_feature (5786)..(5786): n is a, c, g, or t
tccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacancccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaaaaaaaaaaaaaaaaaaaaaaaaaaaaatttgtggggggttgggccggagaaaggttttaaaacatttttttggggggcggggccccggtgttagtggaatgggccaaagttgtccacgagaaccgggcatgacaggggctcggtttcccacccaaaaaaaacgccggggacgcgtgtttgaacaatccgaaggttcggggccccgggtcccacacgggaccagcatcgataataacgccgcggggaaaagagaaagaaaaagagaaaaacagagagagggagatgaaaacataaaacaagacaggagaaaacagaagcaggagaaaacgacgaaaagaaagagaaaccgaaaggagacagacaagaggaacaaaag

SEQ ID NO: 449650 - DNA, 6982 bp, Homo sapiens
  misc_feature (5651)..(5651): n is a, c, g, or t
tccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacancccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaa

SEQ ID NO: 449651 - DNA, 5961 bp, Homo sapiens
  misc_feature (4630)..(4630): n is a, c, g, or t
ttttctgccagtatgttatatatttgagtgaaacatttatttaaaaataattagattttttttcccctctggggtttacttaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacancccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaa

SEQ ID NO: 449652 - DNA, 5617 bp, Homo sapiens
  misc_feature (4286)..(4286): n is a, c, g, or t
tctttctcatctataaattggggagcatatttgatttaactcactattgttaaaagggtcaaaatgagataattcgtgtccaaataattgaaaactgtagaatgtcaatcaaatgtaactgtatgacctgggttccaaactttttaatttaccctttttttttttggaaactctagtttgccacctaggatttaaagcatcagatatggtttgatagctgtatattctataacataattgcttttctttattttgtatgcagtacttccttcaacttacagtgtctgaaattacatttgcctttttgccagttagccaaacttctcatgttcatgtttaagtgaactaccatacctgtgttataatgtatattgtcatcatttgtacacagttgaagagtaatctgtaattaaagactagtgtaatgacttttaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacancccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaa

SEQ ID NO: 449653 - DNA, 2389 bp, Homo sapiens
tccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaaggtaaggagctccccctttctcctcttctcatggaatggtctgaaatattttaatagatacgtaagctatcactagttaatgctcctgattggaagacgtgctccatattttacataaatctctttattcttcagagtggtttcttttaaagatgcttttgtagggagatggttaaagagaaggggacaggtattatatagtaggcctatgacatttttgaggcttaaatcctgaatttgtagtgaattctcaaaattaagatgtcacgaatgcatgggatctctggaattgtcacaagtattttcattttgttttctttta

SEQ ID NO: 449654 - DNA, 1671 bp, Homo sapiens
tccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggttggattcagatgccgaggacacagtacttcctcagaaagaagacagaatttgcaaaagagaccagataataagcatttaagctctagtcaatcccatagaagcgatccaaattctgagtctttatattttgaggtatttttttcaaactctatttgtaagctgttataggaaatgttcccattaagaaattaatttgttacattgtgaacattgtgagtactttttatgtcttaacatgtgattctagtattaaattataaattactcagaagtattaactcatttttgtcttggttatatatatttaatctaacattaattttactgatgtttatttttataaatttttgtcctgtgtgttcatcatttagggggtaatgtatagaggtagaacttgatttcatgtggactttatttagtatggagctt

SEQ ID NO: 449655 - DNA, 345 bp, Homo sapiens
tgatccctccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcaggtacgcgggtttgggctgggcccgccgagccgggggttggggtcgccgcttcctcacaggccaggcccagttctccgaacgtggggaccgggggccggtcctgcggccgc

SEQ ID NO: 449656 - DNA, 441 bp, Homo sapiens
aagtaccttacttgtcagaaacttgatctttaaaataagtgatgcacttggtgaaaatttattgagttgtacacttgcgtgtacttttctgccagtatgttatatatttgagtgaaacatttatttaaaaataattagattttttttcccctctggggtttacttaggttggattcagatgccgaggacacagtacttcctcagaaagaagacagaatttgcaaaagagaccagataataagcatttaagctctagtcaatcccatagaagcgatccaaattctgagtctttatattttgaggtatttttttcaaactctatttgtaagctgttataggaaatgttcccattaagaaattaatttgttacattgtgaacattgtgagtactttttatgtcttaacatgtgattctagtattaaattataaattactcagaa

SEQ ID NO: 449657 - DNA, 7062 bp, Homo sapiens
  misc_feature (5731)..(5731): n is a, c, g, or t
tccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacancccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaa

SEQ ID NO: 449658 - DNA, 7574 bp, Homo sapiens
  misc_feature (5786)..(5786): n is a, c, g, or t
  misc_feature (7532)..(7532): n is a, c, g, or t
tccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacancccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaaaaaaaaaaaaaaaaaaaaaaaaaaaaaacaaaaaaaaaaaaaaaaaaagaaaagaaacaacaagcaaaaacacaacaaggggcgggcggccgagaccacaatacaacacacggcggggagaaaaaatgggcgcccacacccacgcgtcaaaaacgaggcggcaacacgagagcgcacaccacaccagacacacaacgaccagcgaccaacgcgccaaagcggcgacgccagcggaaaaaaccacaactgccgagcagtgcgggcacaaaagccgacccaccagcgaagaggagaacacaccagcacgcgctaccagaacacgatccaagcacacaaggcagccaacaccaccggcacagccaagctaacaacaagagcaagcgcacgatgcacacagcgcacacacgcgctgacngaaacaccacacgccccgctcaaacaaacccacaacacgcag

SEQ ID NO: 449659 - DNA, 8326 bp, Homo sapiens
  misc_feature (1250)..(1250): n is a, c, g, or t
  misc_feature (6995)..(6995): n is a, c, g, or t
tgagattgaacatctaatctcatagttgccaagacagtctctggtgtaaaagaaaataccaagcaatagtccttaactttgaagctgtcatggttagcatatattagtatttctagactcagattttagtttaaatttatgtctgtgctatagttacaggatgatttagcaaaattgcccgcaattaggtcatgtgtaacctagtggttagggtgttacttatgatagtcgtgatagccattctaaccctgcttatactgtctgagtgattagcacttcattggtatagtttattttatggctgtataaaagtactttcagcctttttcaagttatgtcacacagaaaatttcgtttttctaggactgtaaatggatgaggcagctgttaactggctataggctctgtcattcctgagggctgagtcaatcaatatttccacccatctataaaccactgttgcacattagtgtgccagtgcacattctttgagaaattgtggatgtatggtatataaggccattcaactactcaaatattaaatgctcaagttaatattctgaggctcttaatcaagagtcttgagggttagacaaatagtagaaactaaggaatcattttcaattgaagttagcatgatattaaatatctttgcctatattggataatgtgcaaactgattcatgaaactaaatttaataatactatttttctatttgaaaaaaatggccaagtatacagtatgataaacttaattgattttcttggtttaccaaataatctttgtgaatttatgagtaaaccagccaacagattatttaaaaaatatttttaagaatatggccgtgaacattttactattttgctttgtcatgggagtaatgaggaaaagccctatgcttcaactccctagtccttaggaccccatattgatttggtgagggggctgctgggacaggaagaattttgctagtgttttatatgaactgcattagaagaagctccactcctgaagatgtcagtggacagatttgcctcttctcttctttcccttggacccagagcctgcttctattgccaggaggggagccaggaaaagagctggacttggccaagtgattaggggagtatgagaggaggagtaggaggctctgagattgagctgaaaatgaggaattaaatcaccctatgtaaagatcaccttacacaatggtcactttactctgttctttacagaaggctgtcacggntgtgtaccttgaatgggaactttggactgccattgttggtagatacagtagctaggtgtttaacttttaggcagaaatatcttgaggaattggaaggcagagttacagacaatgctggtatgtggaatactgtaaaaccatcaggttgggttcgtttatactgttgtttacattgttactgcatgtacataatgatctctatagcaaagaaatttataagatgatgatagttttgtctcctttcccaaaattatcatgaagccactgttctgttttgtcttttattagtgtaagttaagagattttgctttagtggtatttttagacttgtcaatagatttgttcttctttgatttggttttgcagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacancccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaa

SEQ ID NO: 449660 - DNA, 5908 bp, Homo sapiens
  misc_feature (4577)..(4577): n is a, c, g, or t
tattttagcatgtgagaaatgacatttcctctttaagaccgactttgaataattcagtaatagaatacaagaaataacttcctcatttttcaatacttctaagcattataaaaagtttaggagtttgccttgaactctttttacttaaaatgtgaaacatttcaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacancccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaa

SEQ ID NO: 449661 - DNA, 5676 bp, Homo sapiens
  misc_feature (4345)..(4345): n is a, c, g, or t
attgtgaagtttcaaaggtagaatggttctgactgaagaccagttgcaaggaattgccatgtttgagggttgtacaggagagtagaactaattatttacccctataatggacttctaaattggttaattgcattggcttagtctctaaaggataggtaaaagctgtatctgagggacactgcctagccatgtatagtgctcctactgttatgatgtcgttttttccatgggaggaggatgttcttgtttttgtagttattggaaattttgaaagtatgtgggattggccctaatggtgaaactaatgttcctctttgtttttagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacancccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaa

SEQ ID NO: 449662 - DNA, 1889 bp, Homo sapiens
tccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacaggtgatatcattagtctgagcaatttgctgtttgtctctgctaatatatgttagatgttgttaatcgaaatttttaaaattttatatatgtatgtgtatatatatgtgtgtgtgtgtgtatatat

SEQ ID NO: 449663 - DNA, 2400 bp, Homo sapiens
ggcctagaccctggaaggcagggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagccaaatgccagtctagatcc

SEQ ID NO: 449664 - DNA, 1013 bp, Homo sapiens
ggcctagaccctggaaggcagggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggaattgtgcaaatgaaacctcgggggagccacacaagggtccccagtgaagccgtcctggggggtgaaaaaaccccgcggtttaacggatcgggaggaaaacccccgaaggaggcaaaaggtctcgaatcagaggtgaaccc

SEQ ID NO: 449665 - DNA, 2445 bp, Homo sapiens
ggcctagaccctggaaggcagggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagtccaaagaggtttctaccctggaatctcactgagtgccccaggagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagccaaatgccagtctagatcc

SEQ ID NO: 449666 - DNA, 1159 bp, Homo sapiens
ggcctagaccctggaaggcagggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagccaaatgccagtctagatcc

SEQ ID NO: 449667 - DNA, 1058 bp, Homo sapiens
ggcctagaccctggaaggcagggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagcagagacagagaaatactaacaaccagaaaaaccagaagcagacaacaaccaagaacacgcttctcaaaagcacaaggttccgaggataacgtacaacacccccaacaacggaagaacccccataaaaaaaatcaaacgactaattatatgataacagtaacggaatgaccaaaccgaatcgatcggggggagataacggcggcggaatgcgaagttagaatcgaatgggcagctgagaatgtgcatgtggaatcgcagggatagcaatagttctcatgcagactggataattgaaaagcgctcaagtaacgtgtttaagagcaattaatcctcaacgagtctccgggtaaaggaaaggctcgggctggcgcagcaggaggagaatcggaaccagagggcgagccggttctgcaatagtcgagcgcgaattgcgtgttaactgtcgaactgcgcatctaaaaaggctgggattactcccctctcgggaagcatgtgtcttagatgaatgcgcgtgtctggtggaaatcggttctactagtgctccgcgggaaatcgttgccgatagtggggatatcg

SEQ ID NO: 449668 - DNA, 2060 bp, Homo sapiens
ggcctagaccctggaaggcagggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagagcgagaggcgcctgggatctgagaggaggctgctgggccttcggggtgagcccccagagctggacctgagctattctcactcggacctggggaaacggcccaccaaggacagctacacgcaggactacatctgcacaagggatgcgctgcgagtccatcatcaccgacttccaggtgatgtagggccatgta

SEQ ID NO: 449669 - DNA, 1514 bp, Homo sapiens
ccggcggcgcggggaggggccgggtgacctcacgccggcccggccaccgcggccattagacccggtccaattgctggggctgcagcgctgcctccgagaccgcgaggtgggtggagcgggtcttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgccgggccccggcgagaaagttgttaaagggagcgaggtggttgttcctggggtccgaggcgcgcctctcacgccctgcccaacagaagccgcagtcccgtggggtctggagacgcagtttcctgttaatgacaataaatccctgctccccctgcctcagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcccaaaaaagcacacaccaacacccaacaaccgacgagaccccccacccacgcgcatcgcgcgccccgacccgccgtcccagccccgcacaaccgcacgccccccaaccaccgggcacaccgacaagtatgaaaaactggcggcggccacagtagaaagaaacgaccgcgagcgagcagactaactaccaaccgacgattaggtcaacgaggagcaggactcagtagaaatacataagagcgccagccaggtaacacacccgcccgaaggcgacagtcctcgtcgatgtgacgaacacaacatatgtcggtgggatcatcgatagcacccaagacgagcgagcgcgggacaaactcatcgctgagcaactcgtgcaagagga

SEQ ID NO: 449670 - DNA, 628 bp, Homo sapiens
cagctggctccagccacgaattctcttttcccgtccagccctctcctcccctcttccctaccaatgtttgttgactccttagtttggccagggaggccaaggggcatgtgaggtatcccgagctgaatgtttctgctgaatgtgcagcctgtactctggatcctgacacagagtgtgacccaccctcttctttgttgcaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttctgtctcccttccgccccgcatgtatcctgacgaccagaaacgccctctacttgagataactggagctggactctgcctgatacaatgca

SEQ ID NO: 449671 - DNA, 2552 bp, Homo sapiens
ccggcggcgcggggaggggccgggtgacctcacgccggcccggccaccgcggccattagacccggtccaattgctggggctgcagcgctgcctccgagaccgcgaggtgggtggagcgggtcttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgccgggccccggcgagaaagttgttaaagggagcgaggtggttgttcctggggtccgaggcgcgcctctcacgccctgcccaacagaagccgcagtcccgtggggtctggagacgcagtttcctgttaatgacaataaatccctgctccccctgcctcagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgatggctcagttcgccagataactcaactttcccattggctaccttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaacga

SEQ ID NO: 449672 - DNA, 2092 bp, Homo sapiens
tgatctacagatccttatttgcggtgcctttccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgatggctcagttcgccagataactcaactttcccattggctaccttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaacga

SEQ ID NO: 449673 - DNA, 2773 bp, Homo sapiens
ccggcggcgcggggaggggccgggtgacctcacgccggcccggccaccgcggccattagacccggtccaattgctggggctgcagcgctgcctccgagaccgcgaggtgggtggagcgggtcttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgccgggccccggcgagaaagttgttaaagggagcgaggtggttgttcctggggtccgaggcgcgcctctcacgccctgcccaacagaagccgcagtcccgtggggtctggagacgcagtttcctgttaatgacaataaatccctgctccccctgcctcagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaacgtcttctcagtagcatgggaattgcttgagggcaggcctgctgtccagatcacgtcactgacttcagcaccttggacaaggcccggcacccagtagggcctcagtattgattggctgcactgagcagagacggagttttgccatgttgcccaggcttgtctgaaactcctgggcttaagcgatctgcctgccttggcctcccaaagtgctgggattacaggtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgatggctcagttcgccagataactcaactttcccattggctaccttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaacga

SEQ ID NO: 449674 - DNA, 2086 bp, Homo sapiens
cttgggttaaaaagtattctgaaagcatcctcactgtcctccctggtcccgcacagtgccagagccgggggtcttggactgagtcagagttgcatgggtgcatctggagggaccttgattggagagaggtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgatggctcagttcgccagataactcaactttcccattggctaccttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaacga

SEQ ID NO: 449675 - DNA, 2755 bp, Homo sapiens
ccggcggcgcggggaggggccgggtgacctcacgccggcccggccaccgcggccattagacccggtccaattgctggggctgcagcgctgcctccgagaccgcgaggtgggtggagcgggtcttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgccgggccccggcgagaaagttgttaaagggagcgaggtggttgttcctggggtccgaggcgcgcctctcacgccctgcccaacagaagccgcagtcccgtggggtctggagacgcagtttcctgttaatgacaataaatccctgctccccctgcctcagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaacgtcttctcagtagcatgggaattgcttgagggcaggcctgctgtccagatcacgtcactgacttcagcaccttggacaaggcccggcacccagtagggcctcagtattgattggctgcactgagcagagacggagttttgccatgttgcccaggcttgtctgaaactcctgggcttaagcgatctgcctgccttggcctcccaaagtgctgggattacaggtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgatggctcagttcgccagataactcaactttcccattggctaccttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaacga

SEQ ID NO: 449676 - DNA, 2182 bp, Homo sapiens
ccggcggcgcggggaggggccgggtgacctcacgccggcccggccaccgcggccattagacccggtccaattgctggggctgcagcgctgcctccgagaccgcgagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgatggctcagttcgccagataactcaactttcccattggctaccttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaacga

SEQ ID NO: 449677 - DNA, 1889 bp, Homo sapiens
cagctggctccagccacgaattctcttttcccgtccagccctctcctcccctcttccctaccaatgtttgttgactccttagtttggccagggaggccaaggggcatgtgaggtatcccgagctgaatgtttctgctgaatgtgcagcctgtactctggatcctgacacagagtgtgacccaccctcttctttgttgcaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgatggctcagttcgccagataactcaactttcccattggctaccttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaacga

SEQ ID NO: 449678 - DNA, 441 bp, Homo sapiens
cagaagggctgggactctggaaaacccagccatgttttctgcagtaagcagctttgtgtggtcaagtaggtgtagccctgatgccatcataaaagtctcccaccttatcttcccaggtggatgagtatgctcttggctcatatttgcataaccaagggggccacttaagtgtcatgaggtatagaagaccaccttctctagagtaagaaaaaaatcacagtaaatcatggaacttcactccctttcattttagataaggaaaccagggcccagagaccacacacaccttccccaaggcccacagccatgcgtctgacccttccacttgttgcttatcctttgtggatgagccaagggcagatgcccggctgggggccagctctgagcctccgtggcccttcccaggaccaatccctctgtttcctctttgtggatctgcag

SEQ ID NO: 449679 - DNA, 520 bp, Homo sapiens
catggtgcctgcaggtctgggtcacaagcttgtgaagttggactggcattggacctggcagagcagggctcaggacatatgttctgctgagctgatagctggggaccactcagctgcaccttcctcactgagccctgtcctggttccacgatctcatgctccctctaacagccctgttcttggttttgcagccagagcctaagcctggagacctgattgagatttttcgccctttctacagacactgggccatctatgttggcgatggatatgtggttcatctggcccctccaagtaagaacacatgggacctccactgtgatgggccccaggggctgggaagagaggggatggggaactgtgggtaacaggtgaccccaacattcttcttgcttcccaactggcagttgtctctgaatgttacaagaagtttgatatggggcagtttggtgtggggcactggttttcaaggtctgctcctgggaacctcagggggttctttagagcaggggtccccaac

SEQ ID NO: 449680 - DNA, 2236 bp, Homo sapiens
ccggcggcgcggggaggggccgggtgacctcacgccggcccggccaccgcggccattagacccggtccaattgctggggctgcagcgctgcctccgagaccgcgagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgatggctcagttcgccagataactcaactttcccattggctaccttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaacga

SEQ ID NO: 449681 - DNA, 2407 bp, Homo sapiens
ggctcactgcaggctccgccccccggggttcacgccattctcttgcctcagcctcccgagtagctgggactacaggcacccgccacctcgcccggctaattttttgtatttttagtagagacggggtttcactgtgttagccaggatggtctcgatctcctgacctcgtgatccacccgcctcggcctcccaaagtcctgggattacgggcgtgagccaccgcgcccggcctatactggtctctctactcctctgcgtcctgcaacacaggagccctcataaggaaatgaagacccaaagaagtagttggtgtcagttacttctacaccgaattggacaaagaataccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgatggctcagttcgccagataactcaactttcccattggctaccttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaacga

SEQ ID NO: 449682 - DNA, 2415 bp, Homo sapiens
ccggcggcgcggggaggggccgggtgacctcacgccggcccggccaccgcggccattagacccggtccaattgctggggctgcagcgctgcctccgagaccgcgaggtgggtggagcgggtcttcctggaagggtgcgataaggccgggcgaggtgcctgggatgcttctccccttccgcgaggaagagataaagttgttaaagggagcgaggtggttgttcctggggtccgaggcgcgcctctcacgccctgcccaacagaagccgcagtcccgtggggtctggagacgcagtttcctgttaatgacaataaatccctgctccccctgcctcagacatctacgcagcgaaatcgagcctggccttgagggtccacaccgcgagggaagatgcgtgcgcccattacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgatggctcagttcgccagataactcaactttcccattggctaccttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaacga

SEQ ID NO: 449683 - DNA, 2534 bp, Homo sapiens
ccggcggcgcggggaggggccgggtgacctcacgccggcccggccaccgcggccattagacccggtccaattgctggggctgcagcgctgcctccgagaccgcgaggtgggtggagcgggtcttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgccgggccccggcgagaaagttgttaaagggagcgaggtggttgttcctggggtccgaggcgcgcctctcacgccctgcccaacagaagccgcagtcccgtggggtctggagacgcagtttcctgttaatgacaataaatccctgctccccctgcctcagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgatggctcagttcgccagataactcaactttcccattggctaccttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaacga

SEQ ID NO: 449684 - DNA, 2283 bp, Homo sapiens
ccggcggcgcggggaggggccgggtgacctcacgccggcccggccaccgcggccattagacccggtccaattgctggggctgcagcgctgcctccgagaccgcgaggtgggtggagcgggtcttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgccgggccccggcgagaaagttgttaaagggagcgaggtggttgttcctggggtccgaggcgcgcctctcacgccctgcccaacagaagccgcagtcccgtggggtctggagacgcagtttcctgttaatgacaataaatccctgctccccctgcctcagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgatggctcagttcgccagataactcaactttcccattggctaccttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaacga

SEQ ID NO: 449685 - DNA, 392 bp, Homo sapiens
tactgggctgaccctggaaggccagtcttgtttgtcccctgcctcctgggttccgccagagagaagcagtggagtaaactgcacagacacagagaaaaccagtcatggaggccaagagctagagagccttgagtggacgtggttaatctcacttggttctcccaagagccctgggaggggggcaatatcatcatcatcatctgacaaatgaagtgaccggcctgggagactgtgctctcctgcttagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449686 - DNA, 206 bp, Homo sapiens
taccttatataccatactttcatcaacttatcctataagcagaaacagccttgactggcacctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449687 - DNA, 203 bp, Homo sapiens
  misc_feature (35)..(35): n is a, c, g, or t
aaccaaaacacccctcattaataaaaaatggatgnacccccaccagtccacacaataactccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449688 - DNA, 4135 bp, Homo sapiens
  misc_feature (18)..(18): n is a, c, g, or t
cgctggtactggccgganttttgggagcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449689 - DNA, 4430 bp, Homo sapiens
  misc_feature (18)..(18): n is a, c, g, or t
cgctggtactggccgganttttgggagcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtacgtacacgcggctcgaacccgcatccaaccagacgccgacccgctcctgagagccttccacactccccgaagccccgcgatggtggatagttcctcttccccaggaactccccactgacactgcccctctgagagccaggtcctcggctcctgacagcctgcctggtcagaccctcagtcctatgggactcgggtgtctgcggcgaaggagctcccgtgagggtcccctctctactcaaacataggacccacctcgatcccgcagtcttcccctgtctctctttctccttaggtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449690 - DNA, 3414 bp, Homo sapiens
caagactgctctcctcagacctcactgtagggtgactgagaagagtcatttatttcctgttccaggtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449691 - DNA, 3604 bp, Homo sapiens
gaccaggcaagtgaacagggtaagcgggcacactcagctagccacctggtccaccccattcagtaacagttgtcaggcaatgccaagtagacatcacagagctcatagagccagaaagctgtactgggcaatggtgacggccgggaagtcgtaggcctggaagccttgaattgctgagccctcacagcctctgtcaggcgtctgcggatccagcggtccaccaggctctcatggcctccgggctgggagagtggctgagggcacaaaacccttcccaaggccacgaagggcaaactcggtggcaattccagagcttgttgcagaactggcggtaacccagtatccggttcacatccaggattatgtgcctacatgtcccaggtcggacatcaacctggatgtgaaccggatactgggttaccgcctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449692 - DNA, 4287 bp, Homo sapiens
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccggtgtgtagggtcctcagtgtgggaggggcttgccgagggctgagcagggctcactcgggccaggctccatcaggccctccctgatttctcctccccgacatttgcagggagtggtgcatttccaggcagctgtggtggggccatcgcatcccagcctactttgtcactgtcagtgacccagcggtgccccctggggaggtgagcagagggccagagctagctgctgggacaccctgctggagtggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449693 - DNA, 4017 bp, Homo sapiens
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449694 - DNA, 4220 bp, Homo sapiens
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaagtgagggtgggggcctgggacgggaggaagatggagggctcctcagggttttaccgcctggccttctcacctacgtgtacccccagccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449695 - DNA, 4039 bp, Homo sapiens
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449696 - DNA, 2512 bp, Homo sapiens
cacacaccaccacccaaccccaaataggctaggtacgaggcgggtgtgaatcggccgaggcttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449697 - DNA, 3512 bp, Homo sapiens
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttgggggtgctgaacctgtgctgtgggggtgggccccggttggggttggtggtgcccccgcaacctgttccttgccgggggtggcggggggggggccccctttgccctggagggggggttcccagggcccggggcggccccccttgtttccccccggggcctgtgtgtggg

SEQ ID NO: 449698 - DNA, 2193 bp, Homo sapiens
  misc_feature (26)..(26): n is a, c, g, or t
aaaggctaggtacgaggctgggtgtnctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449699 - DNA, 2528 bp, Homo sapiens
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccgggcctggggggccgtgggttggtttttgctggggcgggagac

SEQ ID NO: 449700 - DNA, 2340 bp, Homo sapiens
aatcacggcgtctggccctgcttcatgcgtttttggtatctttccgcccccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctggtgaggctgcctgaggcaagagtgcccgggtcagggagatggagggatggctgggcatcgccatgatgaggcctcattcctacccagggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449701 - DNA, 1445 bp, Homo sapiens
  misc_feature (18)..(18): n is a, c, g, or t
cgctggtactggccgganttttgggatgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449702 - DNA, 668 bp, Homo sapiens
tactgggctgaccctggaaggccagtcttgtttgtcccctgcctcctgggttccgccagagagaagcagtggagtaaactgcacagacacagagaaaaccagtcatggaggccaagagctagagagccttgagtggacgtggttaatctcacttggttctcccaagagccctgggaggggggcaatatcatcatcatcatctgacaaatgaagtgaccggcctgggagactgtgctctcctgcttaggtggggacactgaatggggaacacgtaggctctgaggttcctttgttcttggggactcaccacttggtggaaaaaggcaagacccaagaggtggtggtggaagtgggggtgctggtgggaatgggtggggagccaggccagccaggttcacgcctcctctgagctactgacctcccatggtcctcgctcatctttccaactttgttgtcctgggtgtttgggggtctcttcacttggacctgggtcctcacccaccccctggttccactccagctcctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449703 - DNA, 450 bp, Homo sapiens
gaactccgtggagtccctcatgacctgggcatcctgatgtacacccaggtgctgtgaagatcacccccgcacatgaccaaaatgactatgaagttgggcagcggcacgggctggaggccatcagcatcatggactcccggggggccctcatcaatgtgcctccgcctttcctggtgaggctgcctgaggcaagagtgcccgggtcagggagatggagggatggctgggcatcgccatgatgaggcctcattcctacccagggcctgcccaggtttgaggccaggaaagcggtgctggtggcgctgaaggagcggggactgttccgtggcattgaggacaaccccatggtggtgccactttgcaagtgagggtgggggcctgggacgggaggaagatggagggctcctcagggttttaccgcctggccttctcacctacgtgtacccccag

SEQ ID NO: 449704 - DNA, 441 bp, Homo sapiens
ccctggccctggcccctgggccacgcctctaaatacccattttacaggtggataagaaggagctgacaggtcgcaccctgctctccgtgcctggctacaaggagaaggtggagttcggggtcctcgtgtcctttgcctataaggtccaaggctcaggtaggagccaggggcaccaggatcctgggctgggagtggcaggaaggggccaaggccaagaccacaaggccttctgtcaccccagatagcgacgaggaggtggtggtggcaacaactcggatcgagacaatgctgggagatgtggctgtagctgtgcaccccaaagataccagataccaggtgggggactgtccacagttagggaaggagttctggccaaaaagggctcccatccttatggggtggaggggttggacttaggcccctggctgaggagaggaaact

SEQ ID NO: 449705 - DNA, 317 bp, Homo sapiens
ggaagaacaagactgctctcctcagacctcactgtagggtgactgagaagagtcatttatttcctgttccaggtcctagacccacctgcccgccggatctggaataatgtgactcgctggtttgtcacgtgtgtccggcagccagaattccgagccgtgctaggagaagtggttctatactcaggagccaggcctctctctcatcagccaggtgaggaagggcgaggagttggaggataggggcttccctggggccttccatgcaactcactttctttttttcctagaaatggcagaatcactggggcagggtcctg

SEQ ID NO: 449706 - DNA, 4134 bp, Homo sapiens
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449707 - DNA, 4071 bp, Homo sapiens
  misc_feature (18)..(18): n is a, c, g, or t
cgctggtactggccgganttttgggagcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccaatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449708 - DNA, 4241 bp, Homo sapiens
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccggtgtgtagggtcctcagtgtgggaggggcttgccgagggctgagcagggctcactcgggccaggctccatcaggccctccctgatttctcctccccgacatttgcagggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449709 - DNA, 3332 bp, Homo sapiens
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgaccagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449710 - DNA, 4602 bp, Homo sapiens
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaaaaaaaaaaaaaaaaaaaaaaaacaaaaaaaaacaaaaaaacgagcacaaaaagaacaaaacacgatatcagaactcagcacgacaaagaagacgacacgtagacaagacctaacaccgatatgaagacacaacagaggaggagcggcggctgccgcgccgagtcagcagcgacaccggcgtggcgcggcgcacacccatacaagccggcagcggagcgcaagcagattgcatagatagtgagtgatggagagcgcagccaacataaaaagcgaggagacacagcgaaactacaagacgcaagacgagacggccgtgcgagaggcgagccaatcacaacaacacgcgagcaaaggaaaaagcaaaccaaagacaggacaggcgagaaagagagaagcaagaaggtcaccagcatcgcagagagagcaaggcagagcaaaagaagaagacaaaaaaagaaagacaacaag

SEQ ID NO: 449711 - DNA, 4062 bp, Homo sapiens
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449712 - DNA, 4307 bp, Homo sapiens
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctggtgaggctgcctgaggcaagagtgcccgggtcagggagatggagggatggctgggcatcgccatgatgaggcctcattcctacccagggcctgcccaggtttgaggccaggaaagcggtgctggtggcgctgaaggagcggggactgttccgtggcattgaggacaaccccatggtggtgccactttgcaagtgagggtgggggcctgggacgggaggaagatggagggctcctcagggttttaccgcctggccttctcacctacgtgtacccccagccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449713 - DNA, 3276 bp, Homo sapiens
  misc_feature (3236)..(3237): n is a, c, g, or t
cggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccagccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagccggaggcctgagagctgtggacgtggatccgcagccgctgacagagnntgggggtcacctcagggtccgcgtacgatccggcggccc

SEQ ID NO: 449714 - DNA, 2619 bp, Homo sapiens
cacacaccaccacccaaccccaaataggctaggtacgaggcgggtgtgaatcggccgaggcttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccggtgtgtagggtcctcagtgtgggaggggcttgccgagggctgagcagggctcactcgggccaggctccatcaggccctccctgatttctcctccccgacatttgcagggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449715 - DNA, 2980 bp, Homo sapiens
cacacaccaccacccaaccccaaataggctaggtacgaggcgggtgtgaatcggccgaggcctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctggtgaggctgcctgaggcaagagtgcccgggtcagggagatggagggatggctgggcatcgccatgatgaggcctcattcctacccagggcctgcccaggtttgaggccaggaaagcggtgctggtggcgctgaaggagcggggactgttccgtggcattgaggacaaccccatggtggtgccactttgcaagtgagggtgggggcctgggacgggaggaagatggagggctcctcagggttttaccgcctggccttctcacctacgtgtacccccagccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449716 - DNA, 1737 bp, Homo sapiens
  misc_feature (1)..(1): n is a, c, g, or t
nattggtgtgggctatgtggattccacattactttgtcactggtaatgtgaccagcggtgccccctgggtgaggtctcttgattggggcggataccttggttatgctgacgcaatgagagcggatgtcccgcgagaaaagcagccaaagtatgttccggaagtttccctcgtgacaaggatccagttctctcaagcaaagactgagggatgtacttgggaatacactggtttctcctctgggcctttgttccccgtaatcccattttgggcctgccccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 449717 - DNA, 1058 bp, Homo sapiens
  misc_feature (18)..(18): n is a, c, g, or t
cgctggtactggccgganttttgggagcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggctggcggaaggacgccacaaacccacgacatcgtgatctccacgcccaaacacccagacataagcagagaactccgcattaaccacaacaacacaagaacaagaccagcgaccctgtgaagcaacgaccgacacaggaagacgagcacctagaagacgatagacgagggcacaaggacatagaaagagcccagccagcaagcaagcccagcaaggacaagacgacgagaccccacgagagtacagacaaactgaacggaaaagccacacaatgcaaccaaaacacgaatgccgacaaacaatacaaaccggaaacacacgggagaataaaacaaacaagcacggcaacagcgaagacaagcaaaaacaacgaacggagaccccgacgatcgaacgagcaccaaaccacaccataggaggacgaccaaagaacaccaaccaaggacacagatacacaggacgagcagccccatcgggcggacaaaggagccaccccggcagcacacagcccatgcagacggccaaaaggacacccaagaccctgaacacaacaccagaacagggagaacaccccagaaacggaaccaccacacaaaaatggccaagcaacaccacgacatccatgacacacaacaacccagtgcgcaagagcgagcacacaccccaccaaacccacggacaacccacacacgac

SEQ ID NO: 449718 - DNA, 1087 bp, Homo sapiens
gttgacactcaaatggtaaattatacattctctatcagcataacactactataacaggaattttcaatttcagaaattttagttaaattatttcaggtagatatttttaggagaagtatcattggatagttaagccatgtctatgtgccttaaaaacagtctccagcaatagccataaggaacttaatttgtagattaattaagacaggtatcagaatatggctatgtagaattaaaggtattttgatactgtttggggcagacctttccagttatatgcttgcagcacatgaacgggtcatatagctcttggtgtaagtgggtgggtaagtaaatggcttgagccatttagaactaaagatcggtaacctgtctacctgcaagcagtctcattaatttaataggccccagtgtatagcataagtatcattttctaagaaaaaagatgggaagtattgggttgaagaactttggcttacgtttccatgctgggcataattgatgcagatgtgaaaacacatcgcatggcctcgtttgaatgtgtgctacccttctcaaccgtaggcatttttctggaccataagtcagtatacccttcttccctcccccagatctctaattttgctgtgccttgaggcacaaatgacattgaaaggctaatttgtatttcttggtgagcaccaggggcctaccctcattttcctccccttgagaattttgtctgttacaaaaaatgtagcctccaggtaaaatatctagtattctgagtttatttgaatttaagagtaaagataatgcttatgtctgtacattgtattctgttttgtctttctcttcaatttctaaagatatttataaagattaagccaagttttagcaatagtttaatatctttgagtagaaaaagaaaagcaaaaatgaacccaatctctgatttaatcaccttaaatgtcatgtttcagcagatcatgacataaaacttcaagacttggtccagtaaattaggagtatgtcgacctctaatctgatagtaacacttgagtttttagaggtctcatttagtggaaggatagcatttgtttttatt

SEQ ID NO: 449719 - DNA, 1488 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtatgccaggtgaccaacaagttctcccatgctcgaaagctctcatgtgacttccggagttagctgacaacttgatactcagcgttagaaatctggaacaaaagggcggaaggggtggccggaattcgttgcagacaatagtggcgcaaaacaaggcaggaagacagaacggagggtaaattaaa

SEQ ID NO: 449720 - DNA, 1024 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaaaaaaaaaaaaattggggggggggttgggcccgaggaaaggtttttaaaaccattgggtggggggggggggccccaaagaggaaaggtacacagtgggccaaaaggggggtcccagggaaactgggggacaggacaaagggcggggattctacccaatataaacaaccgcccggggggggaaacagcagagggtcttggcgaacaaagctcagagggggcactcgagagggcaacaccgggaggaaaatacaacgggcgctccccaggagagccagagatcacattgccccgtccgtgggtgaa

SEQ ID NO: 449721 - DNA, 2842 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaataacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttg

SEQ ID NO: 449722 - DNA, 2511 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaataacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaggtacaccgtactagctacgggtacgagctcggttgt

SEQ ID NO: 449723 - DNA, 2411 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaataacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatggtctggcatttcctggtgcaccgaacagaaagttgccatgtatgtagcacctgaaaggttatacacaactcagagatgagctgtcattg

SEQ ID NO: 449724 - DNA, 2255 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaataacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcacagaccccaaaagagcaaagaccccaaaagagcaaagaccccaaaagagcaaagaccccaaaagagcagagaccacataagagcaaagaccccagaaggggt

SEQ ID NO: 449725 - DNA, 3041 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaataacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataactggggcgattttcacagggggggccgttaaaggcccgtctccgggttgccttggcaagctcgaaaaaatgcattacacgagtatatccttgaaatggagataccatcttctataggcacaacatgtctgcgtgttgcgtcgctgtgtcgcgtagggctgagcgtaacctcacctaccaccacgccgtacaacaagacaaccacgtacacaaaacacgacaagccacccagacaaaacacacgacgaacacaacacaccaaacaacaacacagctcaaaaaacaggaagcgaccacagaggaacgggcagcggcgagagagagaagggaggcagagcaggaccgacaacaagagaggagaacaacgcacagaaaatgacgagaagaagacggatcacgaggggacaggagagaagagcgtcgcgcaagacgataggaaagaagaacacgaaccgaacaaaaacaacacaagcaaacgcgcgacgacagacagcgcagacacaaaggaaccagaacaagagaagagatgacggacgggaggggaaaggagaagagaagagacgaaggcgagaccagaaagacacgagcagggaagcggacgaggtgcgaggagacagagagcagccagaccgaagagacaggcagagagagcagcagaaagcgacaaaagaagacagcacagagcgagagaggacagcgcgaacaagaaaaccggcacgagagagagaaggaagcgaagcggacaggaacgacagaaggaaaaagcggagaacaagcgaagagaggggagagacgacaacaacaagaacagacaagaagaaggaacgcacggagcaaaggcgagagaaggagcaaacgagagaacaagacgacaggagcacaggagaagcagacacggagagagagcaaaaaacgagaacgaagagcaggaagaggagagaaaggcaagagacaaaggaaggactaagaaacgaccgccaacaccacacgcgaa

SEQ ID NO: 449726 - DNA, 1751 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaataacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgactgctgtttagttgaggacactcttgaattcttttgaggtaaagcaccagcccga

SEQ ID NO: 449727 - DNA, 716 bp, Homo sapiens
gccttctaatatgtttgaaaaatttagaaactactggcaattgttaataatggtttttatttatagttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttg

SEQ ID NO: 449728 - DNA, 475 bp, Homo sapiens
tcagctctctgttttggaaaatggagtaagttgtagttttaatttttaaaacataatgtcatgggctgtcgttttagcaatacagctctgttttgtttcaagaaaatttaagtgaggctgaaattagagcaaggtcagaggagtatgtttgttcaaagacatcttgcaagtgcgccttttcttctcctggaagtatacaaagtctctcccagacctctcaagcaaaattccagcatacatgattttttgttgtttaccctctgaacatttgagaatttccttctggccttcatgggtaaagagtcattctttttggggagataagtgaaaaagaagaaactggagttaagaacaaaagtagaggtaaaatagattgcagagaaggatagaagttcctgcagtgactcttgggaaggatgaataatgataagacagtgggtaatagttccagtgaggagagacatgagttcaatta

SEQ ID NO: 449729 - DNA, 423 bp, Homo sapiens
tcctgggctcaagcgattctcctgcctcagcctcccgagtagctgggattacagtcacacgccaccatgcctggctaatttttgtatttttttttttagtagagatgaggtttcaccacgttggccaggctggtcttgaactcctgacctcaagtgaaccacccacgtcagcttcccaaagtgctgagattacagtcgtgagtcaccgcacccggccaagcattttaaattttatatatctgtgggtaacttttcttattttaatttgtttagtgctgaacaaatggcagatgaacccatatgacagaggatctgcttttggtaagtggatagactttccatcagctcatttgtaattcagaaactttaaaaaataatacatgagaacaccaagtaaataagattaagatttaatttaccaga

SEQ ID NO: 449730 - DNA, 423 bp, Homo sapiens
aagtgatataattgagccaaagtattgctgacaagttatttcaagcatgtcatttacattactttgttatttgtgtgtgatgcaggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactatattttcatgaagg

SEQ ID NO: 449731 - DNA, 296 bp, Homo sapiens
atgtcactctgcccgatgaaaagcaaaactacgtacatcgaattggcagagtaggaagagctgaaaggtacttctgcaattttttttcccccatttttaagcttgtatgctttaggaataaagtctaatagaaggcttttaaccatctttcaggatgggtctggcaatttccctggtggcaacagaaaaagaaaaggtaatctttgtagggctctattatattcattgtgtgtgttgtgattttagatgttggaaataaaagcagtttgattttcccatttaaatttaattcagct

SEQ ID NO: 449732 - DNA, 637 bp, Homo sapiens
cccccagatctctaattttgctgtgccttgaggcacaaatgacattgaaaggctaatttgtatttcttggtgagcaccaggggcctaccctcattttcctccccttgagaattttgtctgttacaaaaaatgtagcctccaggtaaaatatctagtattctgagtttatttgaatttaagagtaaagataatgcttatgtctgtacattgtattctgttttgtctttctcttcaatttctaaagatatttataaagattaagccaagttttagcaatagtttaatatctttgagtagaaaaagaaaagcaaaaatgaacccaatctctgatttaatcaccttaaatgtcatgtttcagcagatcatgacataaaacttcaagacttggtccagtaaattaggagtatgtcgacctctaatctgatagtaacacttgagtttttagaggtctcatttagtggaaggatagcatttgtttttattgtttagtatatgtgctaacaaactcctttctctcttcactgttctctttagaaaggagatgtaagattcttgatttgcacagatgtagctgctagaggaattgatatccacggtgttccttatggtaaaaagcaactttttatgcctgtagtgt

SEQ ID NO: 449733 - DNA, 2895 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaataacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttg

SEQ ID NO: 449734 - DNA, 2706 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaataacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttg

SEQ ID NO: 449735 - DNA, 2616 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaataacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatcatgagaatagcacgggaaagaccagccctcatgattcaattaccttacctgggtccttcccataacacatgaaaattctgggagacacaattcaagttgagatttgggcgggacacagccaatcatatcaccaccaggatcttccagtccg

SEQ ID NO: 449736 - DNA, 2318 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaataacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgacaaggctcggtcgcttccttatgttattaatgtcacgctcgacgtgataagatgcaatactaccagcttgagctcttggaggattacgcatgc

SEQ ID NO: 449737 - DNA, 834 bp, Homo sapiens
ttaatgtgcttttcactaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttg

SEQ ID NO: 449738 - DNA, 1596 bp, Homo sapiens
gtaacaaatacctactggctgccaggcactcactggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccggaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaataacatcaagcagtttaagaaatacattgataatcctaaattaagggagcttctgataattggaggtgttgcagcccgggatcagctctctgttttggaaaatggaaagctgacttaatcttaagctagattcctggccctggatgaaactgatgggcctctttcttaaaggtattctgtttattagggagcccctccg

SEQ ID NO: 449739 - DNA, 3587 bp, Homo sapiens
  misc_feature (61)..(61): n is a, c, g, or t
  misc_feature (127)..(127): n is a, c, g, or t
gggacccgttctgctaggaagaaggggagcaggtggtgctgctactcgggaggaagcaganagcctccgtcgctgtcgctgagagcctcacgagtcgaggtcctgcaggtggagctccgcgcagccngccctggttgaaggtttagaacagatgtggaaaaatgtttacttcagagaaaggggttgtggaggaatggttgtcagagtttaagacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggaaatagttgacaaacagggacataccaaagtattgagttttacgattccatctttatccaaaccatctgtataccatgaaccttccagcattgggtccatggctctgactgagagtgcactatcccagcatggtttgtcaaaagcggtatacagtggacctcatcctcaaagggagatgctgacagcacagaatcggtttgaagtgttgacattccttttgttgtgttacaatgctgccttaacttgcatgcccagtgtttctcttcagtcactgtgtcaaatttgttcaagaatctgtgtttgtggatatcctcgacaacatgtaagaaaatataaaggtataagtagcaggataccagtttcttcaggattcatggtgcaaatgttaacagggatttattttgccttttataatggagaatgggatctagctcaaaaagcactggatgatattatatacagagcccagctagaattatatccagagccattgctggttgctaatgcaataaaggcttcattgcctcatggtcccatgaaatctaataaggaaggtacaaggtgtattcaagttgaaatcacaccaacttcctctcgaatatcaagaaatgcagtaaccagcatgtcaataaggggtcataggtggaaaagacatggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactggttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaagtgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagtaacagaatggaataagatctattgccataaattgtagttaagaactgtaaggcaatcgggcagtgaaacttgatattgtattaacttaataggaaccctgtgtacaatttaaaatatttgtaaaatatcactgtgaatttaca

SEQ ID NO: 449740 - DNA, 2948 bp, Homo sapiens
ggcgactctagaggaccccatacagagccagttagaattatatccagagcattgctggttgctaatgcaataaaggcttcattgcctcatggtcccatgaaatctaataaggaaggtacaaggtgtattcaagttgaaatcacaccaacttcctctcgaatatcaagaaatgcagtaaccagcatgtcaataaggggtcataggtggaaaagacatgagcaacctgacaacaataatgatgctactgaattgggcatccttgtcattcctgagattagtgtcacaaatgtggccggagagagaaccgggaatggggaaaaaggcagaacactaggagagattgatgctcagcatatacagggtgtgcaggaaacagccacagatcctagaactgagagcaaaggcttgccagagatcaggaggcaaaaatctgtaagaaaaatgatggaggatggaataaactcacctggcagagtgcagttttagcagagcactttataactgcactccaaggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactggttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaagtgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagtaacagaatggaataagatctattgccataaattgtagttaagaactgtaaggcaatcgggcagtgaaacttgatattgtattaacttaataggaaccctgtgtacaatttaaaatatttgtaaaatatcactgtgaatttaca

SEQ ID NO: 449741 - DNA, 3802 bp, Homo sapiens
  misc_feature (61)..(61): n is a, c, g, or t
  misc_feature (127)..(127): n is a, c, g, or t
gggacccgttctgctaggaagaaggggagcaggtggtgctgctactcgggaggaagcaganagcctccgtcgctgtcgctgagagcctcacgagtcgaggtcctgcaggtggagctccgcgcagccngccctggttgaaggtttagaacagatgtggaaaaatgtttacttcagagaaaggggttgtggaggaatggttgtcagagtttaagacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggaaatagttgacaaacagggacataccaaagtattgagttttacgattccatctttatccaaaccatctgtataccatgaaccttccagcattgggtccatggctctgactgagagtgcactatcccagcatggtttgtcaaaagcggtatacagtggacctcatcctcaaagggagatgctgacagcacagaatcggtttgaagtgttgacattccttttgttgtgttacaatgctgccttaacttgcatgcccagtgtttctcttcagtcactgtgtcaaatttgttcaagaatctgtgtttgtggatatcctcgacaacatgtaagaaaatataaaggtataagtagcaggataccagtttcttcaggattcatggtgcaaatgttaacagggatttattttgccttttataatggagaatgggatctagctcaaaaagcactggatgatattatatacagagcccagctagaattatatccagagccattgctggttgctaatgcaataaaggcttcattgcctcatggtcccatgaaatctaataaggaaggtacaaggtgtattcaagttgaaatcacaccaacttcctctcgaatatcaagaaatgcagtaaccagcatgtcaataaggggtcataggtggaaaagacatgagcaacctgacaacaataatgatgctactgaattgggcatccttgtcattcctgagattagtgtcacaaatgtggccggagagagaaccgggaatggggaaaaaggcagaacactaggagagattgatgctcagcatatacagggtgtgcaggaaacagccacagatcctagaactgagagcaaaggcttgccagagatcaggaggcaaaaatctgaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactggttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaagtgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagtaacagaatggaataagatctattgccataaattgtagttaagaactgtaaggcaatcgggcagtgaaacttgatattgtattaacttaataggaaccctgtgtacaatttaaaatatttgtaaaatatcactgtgaatttaca

SEQ ID NO: 449742 - DNA, 2886 bp, Homo sapiens
aaaataatctacaatatagagtacaaccttctaaaaaagtctttaaagtattctaataccaattttttaaaagttccttggtaagagctttgattttatactgctttgctactgaaggagagttcacccctagttttactgcgtgatatttctaattgtttcttatcttttgcatgaataggagaattctttctaaaaacttaatggggtatggtttatggcatgctttttgtttaatacactataaattactgtcatttaattacagtgaagtatttttgacattttataataaatgttttgatttatcctttgattttctataatctgttgctttataaattatgctaaagcttaatttatgtaaagcataactgatttggtgttaatcatttaaaaagattgcttaaaatacttaatgttaattaatctttgtcatttctttgtttaggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactggttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaagtgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagtaacagaatggaataagatctattgccataaattgtagttaagaactgtaaggcaatcgggcagtgaaacttgatattgtattaacttaataggaaccctgtgtacaatttaaaatatttgtaaaatatcactgtgaatttaca

SEQ ID NO: 449743 - DNA, 3883 bp, Homo sapiens
  misc_feature (61)..(61): n is a, c, g, or t
  misc_feature (127)..(127): n is a, c, g, or t
gggacccgttctgctaggaagaaggggagcaggtggtgctgctactcgggaggaagcaganagcctccgtcgctgtcgctgagagcctcacgagtcgaggtcctgcaggtggagctccgcgcagccngccctggttgaaggtttagaacagatgtggaaaaatgtttacttcagagaaaggggttgtggaggaatggttgtcagagtttaagacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggaaatagttgacaaacagggacataccaaagtattgagttttacgattccatctttatccaaaccatctgtataccatgaaccttccagcattgggtccatggctctgactgagagtgcactatcccagcatggtttgtcaaaagcggtatacagtggacctcatcctcaaagggagatgctgacagcacagaatcggtttgaagtgttgacattccttttgttgtgttacaatgctgccttaacttgcatgcccagtgtttctcttcagtcactgtgtcaaatttgttcaagaatctgtgtttgtggatatcctcgacaacatgtaagaaaatataaaggtataagtagcaggataccagtttcttcaggattcatggtgcaaatgttaacagggatttattttgccttttataatggagaatgggatctagctcaaaaagcactggatgatattatatacagagcccagctagaattatatccagagccattgctggttgctaatgcaataaaggcttcattgcctcatggtcccatgaaatctaataaggaaggtacaaggtgtattcaagttgaaatcacaccaacttcctctcgaatatcaagaaatgcagtaaccagcatgtcaataaggggtcataggtggaaaagacatgagcaacctgacaacaataatgatgctactgaattgggcatccttgtcattcctgagattagtgtcacaaatgtggccggagagagaaccgggaatggggaaaaaggcagaacactaggagagattgatgctcagcatatacagggtgtgcaggaaacagccacagatcctagaactgagagcaaaggcttgccagagatcaggaggcaaaaatctgtaagaaaaatgatggaggatggaataaactcacctggcagagtgcagttttagcagagcactttataactgcactccaaggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactggttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaagtgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagtaacagaatggaataagatctattgccataaattgtagttaagaactgtaaggcaatcgggcagtgaaacttgatattgtattaacttaataggaaccctgtgtacaatttaaaatatttgtaaaatatcactgtgaatttaca

SEQ ID NO: 449744 - DNA, 2501 bp, Homo sapiens
attcggcaccagggagaacagcaggaagactactcaatgttgaatttcctgccaccaaactcagaggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactggttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaagtgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagtaacagaatggaataagatctattgccataaattgtagttaagaactgtaaggcaatcgggcagtgaaacttgatattgtattaacttaataggaaccctgtgtacaatttaaaatatttgtaaaatatcactgtgaatttaca

SEQ ID NO: 449745 - DNA, 2071 bp, Homo sapiens
cccccgggtgcgcctgcgcggagctcgtggccgcgcctgctcccgccgggggctccttgctcggccgggccgcggccatgggagaggccgaggtgggcggcgggggcgccgcaggcgacaagggcccgggggaggcggccaccagcccggcggaggagacagtggtgtggagccccgaggtggaggtgtgcctcttccacgccatgctgggccacaagcccgtcggtgtgaaccgacacttccacatgatttgtattcgggacaagttcagccagaacatcgggcggcaggtcccatccaaggtcatctgggaccatctgagcaccatgtacgacatgcaggcgctgcatgagtctgagattcttccattcccgaatccagagaggaacttcgtccttccagaagagatcattcaggaggtccgagaaggaaaagtgatgatagaagaggagatgaaagaggagatgaaggaagacgtggacccccacaatggggctgacgatgttttttcatcttcagggagtttggggaaagcatcagaaaaatccagcaaagacaaagagaagaactcctcagacttggggtgcaaagaaggcgcagacaagcggaagcgcagccgggtcaccgacaaagtcctgaccgcaaacagcaacccttccagtcccagtgctgccaagcggcgccgcacgtagaccctcagccctggtggcggcagagaagcgggcgaggcactgtggtcgctgagggggttggctgggtctgagtgccaccccccaggccacagtgataccatcccagtgccatgagcccacactgcccgccctcaggctctcaggtgaacgtggccgtcagcggggaaacgtgtgtgtcagttggaccatgtgggaccctgatggacctgaaagaccaggatcggtccagctcagatattgagggctctgaagcctagttctgtcttctctggagcagctgtggcttccccgtggctgcttggtgacatggattagcgctacgtgggctgcagcatttgggatccaggctacctagaggggcatcgggccagggaaaacctcggattagcaagcaataaaaacatgacctcactcttcctcaaaggagcccctggtcttccctgtgtgactcagttctttccatctgtttgtcccgctgcaagcctctttctgcgctgactgtgacatcggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatccaacctggagttgtgtgattttgataccaaagtaagttcacttttcctccaaaaggaagtttttatttttccaagatttataactaaagcatacacttagatgacttattaacattcacttgatacaacatataaacaaaatagtaacagattctgagtggttattttgtggactgtgacaagcacttcaaatacaaaatgttaggagggcaaaacggtgcgggccctcgtaggtcaggcaggcaccagtgggctccttcctgctgaaagctgcggctgtgagatgagaccgctggctgggtcacagagtgaaatccagcgttccgtgtgcggacgaggagacaagctgtcctggccagccatcgcaccccaatgtcttcagcttgacgttgcttctctgccagtggagcctcctccaccacctgggaacat

SEQ ID NO: 449746 - DNA, 2376 bp, Homo sapiens
cccccgggtgcgcctgcgcggagctcgtggccgcgcctgctcccgccgggggctccttgctcggccgggccgcggccatgggagaggccgaggtgggcggcgggggcgccgcaggcgacaagggcccgggggaggcggccaccagcccggcggaggagacagtggtgtggagccccgaggtggaggtgtgcctcttccacgccatgctgggccacaagcccgtcggtgtgaaccgacacttccacatgatttgtattcgggacaagttcagccagaacatcgggcggcaggtcccatccaaggtcatctgggaccatctgagcaccatgtacgacatgcaggcgctgcatgagtctgagattcttccattcccgaatccagagaggaacttcgtccttccagaagagatcattcaggaggtccgagaaggtgaggctcgggaaaggttgggcttgggattcagaaaaggccagaccctggccaagggcagggaggtgagggtgaggaccccgggcctccagggaggtgtgagggtccagcgcagaccccgccctacctgtgcttgggtggtcttggaacctccgggattggagaggactttgtttgagagcagtggctggacggaagctgaggcctgtgtgggcagcaagcgtcggagcagtccctggcctgaccatcccccagcgtcggccaccaccgtgggttttcggtgagcgtcagctgtctcctccacagaaaagtgatgatagaagaggagatgaaagaggagatgaaggaagacgtggacccccacaatggggctgacgatgttttttcatcttcagggagtttggggaaagcatcagaaaaatccagcaaagacaaagagaagaactcctcagacttggggtgcaaagaaggcgcagacaagcggaagcgcagccgggtcaccgacaaagtcctgaccgcaaacagcaacccttccagtcccagtgctgccaagcggcgccgcacgtagaccctcagccctggtggcggcagagaagcgggcgaggcactgtggtcgctgagggggttggctgggtctgagtgccaccccccaggccacagtgataccatcccagtgccatgagcccacactgcccgccctcaggctctcaggtgaacgtggccgtcagcggggaaacgtgtgtgtcagttggaccatgtgggaccctgatggacctgaaagaccaggatcggtccagctcagatattgagggctctgaagcctagttctgtcttctctggagcagctgtggcttccccgtggctgcttggtgacatggattagcgctacgtgggctgcagcatttgggatccaggctacctagaggggcatcgggccagggaaaacctcggattagcaagcaataaaaacatgacctcactcttcctcaaaggagcccctggtcttccctgtgtgactcagttctttccatctgtttgtcccgctgcaagcctctttctgcgctgactgtgacatcggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatccaacctggagttgtgtgattttgataccaaagtaagttcacttttcctccaaaaggaagtttttatttttccaagatttataactaaagcatacacttagatgacttattaacattcacttgatacaacatataaacaaaatagtaacagattctgagtggttattttgtggactgtgacaagcacttcaaatacaaaatgttaggagggcaaaacggtgcgggccctcgtaggtcaggcaggcaccagtgggctccttcctgctgaaagctgcggctgtgagatgagaccgctggctgggtcacagagtgaaatccagcgttccgtgtgcggacgaggagacaagctgtcctggccagccatcgcaccccaatgtcttcagcttgacgttgcttctctgccagtggagcctcctccaccacctgggaacat

SEQ ID NO: 449747 - DNA, 2192 bp, Homo sapiens
cccccgggtgcgcctgcgcggagctcgtggccgcgcctgctcccgccgggggctccttgctcggccgggccgcggccatgggagaggccgaggtgggcggcgggggcgccgcaggcgacaagggcccgggggaggcggccaccagcccggcggaggagacagtggtgtggagccccgaggtggaggtgtgcctcttccacgccatgctgggccacaagcccgtcggtgtgaaccgacacttccacatgatttgtattcgggacaagttcagccagaacatcgggcggcaggtcccatccaaggtcatctgggaccatctgagcaccatgtacgacatgcaggcgctgcatgagtctgagattcttccattcccgaatccagagaggaacttcgtccttccagaagagatcattcaggaggtccgagaagtggctggacggaagctgaggcctgtgtgggcagcaagcgtcggagcagtccctggcctgaccatcccccagcgtcggccaccaccgtgggttttcggtgagcgtcagctgtctcctccacagaaaagtgatgatagaagaggagatgaaagaggagatgaaggaagacgtggacccccacaatggggctgacgatgttttttcatcttcagggagtttggggaaagcatcagaaaaatccagcaaagacaaagagaagaactcctcagacttggggtgcaaagaaggcgcagacaagcggaagcgcagccgggtcaccgacaaagtcctgaccgcaaacagcaacccttccagtcccagtgctgccaagcggcgccgcacgtagaccctcagccctggtggcggcagagaagcgggcgaggcactgtggtcgctgagggggttggctgggtctgagtgccaccccccaggccacagtgataccatcccagtgccatgagcccacactgcccgccctcaggctctcaggtgaacgtggccgtcagcggggaaacgtgtgtgtcagttggaccatgtgggaccctgatggacctgaaagaccaggatcggtccagctcagatattgagggctctgaagcctagttctgtcttctctggagcagctgtggcttccccgtggctgcttggtgacatggattagcgctacgtgggctgcagcatttgggatccaggctacctagaggggcatcgggccagggaaaacctcggattagcaagcaataaaaacatgacctcactcttcctcaaaggagcccctggtcttccctgtgtgactcagttctttccatctgtttgtcccgctgcaagcctctttctgcgctgactgtgacatcggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatccaacctggagttgtgtgattttgataccaaagtaagttcacttttcctccaaaaggaagtttttatttttccaagatttataactaaagcatacacttagatgacttattaacattcacttgatacaacatataaacaaaatagtaacagattctgagtggttattttgtggactgtgacaagcacttcaaatacaaaatgttaggagggcaaaacggtgcgggccctcgtaggtcaggcaggcaccagtgggctccttcctgctgaaagctgcggctgtgagatgagaccgctggctgggtcacagagtgaaatccagcgttccgtgtgcggacgaggagacaagctgtcctggccagccatcgcaccccaatgtcttcagcttgacgttgcttctctgccagtggagcctcctccaccacctgggaacat

SEQ ID NO: 449748 - DNA, 2058 bp, Homo sapiens
cttaaacaaaactctctatttgatatcagcatgagtctgagattcttccattcccgaatccagagaggaacttcgtccttccagaagagatcattcaggaggtccgagaaggtgaggctcgggaaaggttgggcttgggattcagaaaaggccagaccctggccaagggcagggaggtgagggtgaggaccccgggcctccagggaggtgtgagggtccagcgcagaccccgccctacctgtgcttgggtggtcttggaacctccgggattggagaggactttgtttgagagcagtggctggacggaagctgaggcctgtgtgggcagcaagcgtcggagcagtccctggcctgaccatcccccagcgtcggccaccaccgtgggttttcggtgagcgtcagctgtctcctccacagaaaagtgatgatagaagaggagatgaaagaggagatgaaggaagacgtggacccccacaatggggctgacgatgttttttcatcttcagggagtttggggaaagcatcagaaaaatccagcaaagacaaagagaagaactcctcagacttggggtgcaaagaaggcgcagacaagcggaagcgcagccgggtcaccgacaaagtcctgaccgcaaacagcaacccttccagtcccagtgctgccaagcggcgccgcacgtagaccctcagccctggtggcggcagagaagcgggcgaggcactgtggtcgctgagggggttggctgggtctgagtgccaccccccaggccacagtgataccatcccagtgccatgagcccacactgcccgccctcaggctctcaggtgaacgtggccgtcagcggggaaacgtgtgtgtcagttggaccatgtgggaccctgatggacctgaaagaccaggatcggtccagctcagatattgagggctctgaagcctagttctgtcttctctggagcagctgtggcttccccgtggctgcttggtgacatggattagcgctacgtgggctgcagcatttgggatccaggctacctagaggggcatcgggccagggaaaacctcggattagcaagcaataaaaacatgacctcactcttcctcaaaggagcccctggtcttccctgtgtgactcagttctttccatctgtttgtcccgctgcaagcctctttctgcgctgactgtgacatcggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatccaacctggagttgtgtgattttgataccaaagtaagttcacttttcctccaaaaggaagtttttatttttccaagatttataactaaagcatacacttagatgacttattaacattcacttgatacaacatataaacaaaatagtaacagattctgagtggttattttgtggactgtgacaagcacttcaaatacaaaatgttaggagggcaaaacggtgcgggccctcgtaggtcaggcaggcaccagtgggctccttcctgctgaaagctgcggctgtgagatgagaccgctggctgggtcacagagtgaaatccagcgttccgtgtgcggacgaggagacaagctgtcctggccagccatcgcaccccaatgtcttcagcttgacgttgcttctctgccagtggagcctcctccaccacctgggaacat

SEQ ID NO: 449749 - DNA, 2017 bp, Homo sapiens
cccccgggtgcgcctgcgcggagctcgtggccgcgcctgctcccgccgggggctccttgctcggccgggccgcggccatgggagaggccgaggtgggcggcgggggcgccgcaggcgacaagggcccgggggaggcggccaccagcccggcggaggagacagtggtgtggagccccgaggtggaggtgtgcctcttccacgccatgctgggccacaagcccgtcggtgtgaaccgacacttccacatgatttgtattcgggacaagttcagccagaacatcgggcggcaggtcccatccaaggtcatctgggaccatctgagcaccatgtacgacatgcaggcgctgcatgagtctgagattcttccattcccgaatccagagaggaacttcgtccttccagaagagatcattcaggaggtccgagaaggaaaagtgatgatagaagaggagatgaaagaggagatgaaggaagacgtggacccccacaatggggctgacgatgttttttcatcttcagggagtttggggaaagcatcagaaaaatccagcaaagacaaagagaagaactcctcagacttggggtgcaaagaaggcgcagacaagcggaagcgcagccgggtcaccgacaaagtcctgaccgcaaacagcaacccttccagtcccagtgctgccaagcggcgccgcacgtagaccctcagccctggtggcggcagagaagcgggcgaggcactgtggtcgctgagggggttggctgggtctgagtgccaccccccaggccacagtgataccatcccagtgccatgagcccacactgcccgccctcaggctctcaggtgaacgtggccgtcagcggggaaacgtgtgtgtcagttggaccatgtgggaccctgatggacctgaaagaccaggatcggtccagctcagatattgagggctctgaagcctagttctgtcttctctggagcagctgtggcttccccgtggctgcttggtgacatggattagcgctacgtgggctgcagcatttgggatccaggctacctagaggggcatcgggccagggaaaacctcggattagcaagcaataaattctttccatctgtttgtcccgctgcaagcctctttctgcgctgactgtgacatcggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatccaacctggagttgtgtgattttgataccaaagtaagttcacttttcctccaaaaggaagtttttatttttccaagatttataactaaagcatacacttagatgacttattaacattcacttgatacaacatataaacaaaatagtaacagattctgagtggttattttgtggactgtgacaagcacttcaaatacaaaatgttaggagggcaaaacggtgcgggccctcgtaggtcaggcaggcaccagtgggctccttcctgctgaaagctgcggctgtgagatgagaccgctggctgggtcacagagtgaaatccagcgttccgtgtgcggacgaggagacaagctgtcctggccagccatcgcaccccaatgtcttcagcttgacgttgcttctctgccagtggagcctcctccaccacctgggaacat

SEQ ID NO: 449750 - DNA, 1640 bp, Homo sapiens
cccccgggtgcgcctgcgcggagctcgtggccgcgcctgctcccgccgggggctccttgctcggccgggccgcggccatgggagaggccgaggtgggcggcgggggcgccgcaggcgacaagggcccgggggaggcggccaccagcccggcggaggagacagtggtgtggagccccgaggtggaggtgtgcctcttccacgccatgctgggccacaagcccgtcggtgtgaaccgacacttccacatgatttgtattcgggacaagttcagccagaacatcgggcggcaggtcccatccaaggtcatctgggaccatctgagcaccatgtacgacatgcaggcgctgcatgagtctgagattcttccattcccgaatccagagaggaacttcgtccttccagaagagatcattcaggaggtccgagaaggaaaagtgatgatagaagaggagatgaaagaggagatgaaggaagacgtggacccccacaatggggctgacgatgttttttcatcttcagggagtttggggaaagcatcagaaaaatccagcaaagacaaagagaagaactcctcagacttggggtgcaaagaaggcgcagacaagcggaagcgcagccgggtcaccgacaaagtcctgaccgcaaacagcaacccttccagtcccagtgctgccaagcggcgccgcacgtagaccctcagccctggtggcggcagagaagcgggcgaggcactgtggtcgctgagggggttggctgggtctgagtgccaccccccaggccacagtgataccatcccagtgccatgagcccacactgcccgccctcaggctctcaggtgaacgtggccgtcagcggggaaacgtgtgtgtcagttggaccatgtgggaccctgatggacctgaaagaccaggatcggtccagctcagatattgagggctctgaagcctagttctgtcttctctggagcagctgtggcttccccgtggctgcttggtgacatggattagcgctacgtgggctgcagcatttgggatccaggctacctagaggggcatcgggccagggaaaacctcggattagcaagcaataaaaacatgacctcactcttcctcaaaggagcccctggtcttccctgtgtgactcagttctttccatctgtttgtcccgctgcaagcctctttctgcgctgactgtgacatcggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatcc

SEQ ID NO: 449751 - DNA, 2031 bp, Homo sapiens
cccccgggtgcgcctgcgcggagctcgtggccgcgcctgctcccgccgggggctccttgctcggccgggccgcggccatgggagaggccgaggtgggcggcgggggcgccgcaggcgacaagggcccgggggaggcggccaccagcccggcggaggagacagtggtgtggagccccgaggtggaggtgtgaaccgacacttccacatgatttgtattcgggacaagttcagccagaacatcgggcggcaggtcccatccaaggtcatctgggaccatctgagcaccatgtacgacatgcaggcgctgcatgagtctgagattcttccattcccgaatccagagaggaacttcgtccttccagaagagatcattcaggaggtccgagaaggaaaagtgatgatagaagaggagatgaaagaggagatgaaggaagacgtggacccccacaatggggctgacgatgttttttcatcttcagggagtttggggaaagcatcagaaaaatccagcaaagacaaagagaagaactcctcagacttggggtgcaaagaaggcgcagacaagcggaagcgcagccgggtcaccgacaaagtcctgaccgcaaacagcaacccttccagtcccagtgctgccaagcggcgccgcacgtagaccctcagccctggtggcggcagagaagcgggcgaggcactgtggtcgctgagggggttggctgggtctgagtgccaccccccaggccacagtgataccatcccagtgccatgagcccacactgcccgccctcaggctctcaggtgaacgtggccgtcagcggggaaacgtgtgtgtcagttggaccatgtgggaccctgatggacctgaaagaccaggatcggtccagctcagatattgagggctctgaagcctagttctgtcttctctggagcagctgtggcttccccgtggctgcttggtgacatggattagcgctacgtgggctgcagcatttgggatccaggctacctagaggggcatcgggccagggaaaacctcggattagcaagcaataaaaacatgacctcactcttcctcaaaggagcccctggtcttccctgtgtgactcagttctttccatctgtttgtcccgctgcaagcctctttctgcgctgactgtgacatcggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatccaacctggagttgtgtgattttgataccaaagtaagttcacttttcctccaaaaggaagtttttatttttccaagatttataactaaagcatacacttagatgacttattaacattcacttgatacaacatataaacaaaatagtaacagattctgagtggttattttgtggactgtgacaagcacttcaaatacaaaatgttaggagggcaaaacggtgcgggccctcgtaggtcaggcaggcaccagtgggctccttcctgctgaaagctgcggctgtgagatgagaccgctggctgggtcacagagtgaaatccagcgttccgtgtgcggacgaggagacaagctgtcctggccagccatcgcaccccaatgtcttcagcttgacgttgcttctctgccagtggagcctcctccaccacctgggaacat

SEQ ID NO: 449752 - DNA, 2158 bp, Homo sapiens
cccccgggtgcgcctgcgcggagctcgtggccgcgcctgctcccgccgggggctccttgctcggccgggccgcggccatgggagaggccgaggtgggcggcgggggcgccgcaggcgacaagggcccgggggaggcggccaccagcccggcggaggagacagtggtgtggagccccgaggtggaggtgtgcctcttccacgccatgctgggccacaagcccgtcggtgtgaaccgacacttccacatgatttgtattcgggacaagttcagccagaacatcgggcggcaggtcccatccaaggtcatctgggaccatctgagcaccatgtacgacatgcaggcgctgagaggaacttcgtccttccagaagagatcattcaggaggtccgagaagtggctggacggaagctgaggcctgtgtgggcagcaagcgtcggagcagtccctggcctgaccatcccccagcgtcggccaccaccgtgggttttcggtgagcgtcagctgtctcctccacagaaaagtgatgatagaagaggagatgaaagaggagatgaaggaagacgtggacccccacaatggggctgacgatgttttttcatcttcagggagtttggggaaagcatcagaaaaatccagcaaagacaaagagaagaactcctcagacttggggtgcaaagaaggcgcagacaagcggaagcgcagccgggtcaccgacaaagtcctgaccgcaaacagcaacccttccagtcccagtgctgccaagcggcgccgcacgtagaccctcagccctggtggcggcagagaagcgggcgaggcactgtggtcgctgagggggttggctgggtctgagtgccaccccccaggccacagtgataccatcccagtgccatgagcccacactgcccgccctcaggctctcaggtgaacgtggccgtcagcggggaaacgtgtgtgtcagttggaccatgtgggaccctgatggacctgaaagaccaggatcggtccagctcagatattgagggctctgaagcctagttctgtcttctctggagcagctgtggcttccccgtggctgcttggtgacatggattagcgctacgtgggctgcagcatttgggatccaggctacctagaggggcatcgggccagggaaaacctcggattagcaagcaataaaaacatgacctcactcttcctcaaaggagcccctggtcttccctgtgtgactcagttctttccatctgtttgtcccgctgcaagcctctttctgcgctgactgtgacatcggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatccaacctggagttgtgtgattttgataccaaagtaagttcacttttcctccaaaaggaagtttttatttttccaagatttataactaaagcatacacttagatgacttattaacattcacttgatacaacatataaacaaaatagtaacagattctgagtggttattttgtggactgtgacaagcacttcaaatacaaaatgttaggagggcaaaacggtgcgggccctcgtaggtcaggcaggcaccagtgggctccttcctgctgaaagctgcggctgtgagatgagaccgctggctgggtcacagagtgaaatccagcgttccgtgtgcggacgaggagacaagctgtcctggccagccatcgcaccccaatgtcttcagcttgacgttgcttctctgccagtggagcctcctccaccacctgggaacat

SEQ ID NO: 449753 - DNA, 1945 bp, Homo sapiens
cccccgggtgcgcctgcgcggagctcgtggccgcgcctgctcccgccgggggctccttgctcggccgggccgcggccatgggagaggccgaggtgggcggcgggggcgccgcaggcgacaagggcccgggggaggcggccaccagcccggcggaggagacagtggtgtggagccccgaggtggaggtgtgcctcttccacgccatgctgggccacaagcccgtcggtgtgaaccgacacttccacatgatttgtattcgggacaagttcagccagaacatcgggcggcaggtcccatccaaggtcatctgggaccatctgagcaccatgtacgacatgcaggcgctgcatgagtctgagattcttccattcccgaatccagagaggaacttcgtccttccagaagagatcattcaggaggtccgagaaggaaaagtgatgatagaagaggagatgaaagaggagatgaaggaagacgtggacccccacaatggggctgacgatgttttttcatcttcagggagtttggggaaagcatcagaaaaatccagcaaagacaaagagaagaactcctcagacttggggtgcaaagaaggcgcagacaagcggaagcgcagccgggtcaccgacaaagtcctgaccgcaaacagcaacccttccagtcccagtgctgccaagcggcgccgcacgtagacccctcaggctctcaggtgaacgtggccgtcagcggggaaacgtgtgtgtcagttggaccatgtgggaccctgatggacctgaaagaccaggatcggtccagctcagatattgagggctctgaagcctagttctgtcttctctggagcagctgtggcttccccgtggctgcttggtgacatggattagcgctacgtgggctgcagcatttgggatccaggctacctagaggggcatcgggccagggaaaacctcggattagcaagcaataaaaacatgacctcactcttcctcaaaggagcccctggtcttccctgtgtgactcagttctttccatctgtttgtcccgctgcaagcctctttctgcgctgactgtgacatcggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatccaacctggagttgtgtgattttgataccaaagtaagttcacttttcctccaaaaggaagtttttatttttccaagatttataactaaagcatacacttagatgacttattaacattcacttgatacaacatataaacaaaatagtaacagattctgagtggttattttgtggactgtgacaagcacttcaaatacaaaatgttaggagggcaaaacggtgcgggccctcgtaggtcaggcaggcaccagtgggctccttcctgctgaaagctgcggctgtgagatgagaccgctggctgggtcacagagtgaaatccagcgttccgtgtgcggacgaggagacaagctgtcctggccagccatcgcaccccaatgtcttcagcttgacgttgcttctctgccagtggagcctcctccaccacctgggaacat

SEQ ID NO: 449754 - DNA, 547 bp, Homo sapiens
gctcggtacctcccttcacagccaaccttggcagttatagcaggagaacactgtcttaatatttctttacattctttcaaaaggcaaaataggattgccctgtattgatgtagaaatgtctgtaaacagagcttgtatggtttgctgggtcaaacaatgtttccaacttaaaatcaatctcattgccactttaactacttttagtcatatttattaagtaatgcagtttgtactttttttattttgtaacattttgtgatttttttgtacaaaactgtatttgtacaatagagcaattcccagctgatggaatgaatgaataaaatgcaaaattatacttttacaatgcctttttggatagagtggtttttaaattgtgatgtttgtaggaaactttcttgcatgtatgcatgtacacaattttttttttccataaagatgccacagcaatagagaggtttcctaaattatcacatgaagaggataggctaatcatgagtaatttcaaaggataagtctgaataaaatataatttaaaagtggagta

SEQ ID NO: 449755 - DNA, 2497 bp, Homo sapiens
gcggccgctgcctcctgctcgccccggcgcccgcagccccggtcccgccgcggcggggctcctcggcctggctcctggaggagctgctgcggcccgactgccccgagcccgcgggcttggacgcgacacgggaggggcccgatcggaacttccgactgagcgagcaccgccaggccctggccgccgccaagcaccgaggccccgcggcgaccccggggagccccgatcccggccccggtccgtggggcgaagagcacttggcggagaggggccccaggggctgggagaggggcggcgatcgctgcgacgcgcccggtggggacgcggcgcggaggcccgacccagaggccgaggcaccccccgccgggagcatcgaggccgccccgagtagtgcggcggagccggtgatcgtctccaggtcggatcccagagacgagaagctggccctatacctggccgaggtggagaagcaggacaagtatctgcggcagaggaataagtaccgattccacatcattccagacggcaactgcctctaccgagctgtcagcaagacggtgtatggggaccagagcctgcaccgggagttgagggagcagacggtgcactacatcgccgaccatttcaaccacttcagccccctgattgagggcgacgtgggggagtttatcatcgctgctgcccaagacggggcatgggccgggtacccggagttgctggccatggggcagatgctgaatgtgaatatccatttaactactggagggaggctggagagtcccacggtgtctaccatgattcattatttgggcccagaggattccctgaggcctagtatttggctcagttggctcagtaacggacactatgatgctgtatttgatcactcctatcctaacccagagtacgacaactggtgcaaacaaactcaagtgcaaaggaaacgcgacgaagaacttgccaaatctatggccatatccttgtctaaaatgtatattgaacaaaatgcatgctcttgaaatgtctcaaaaccttacaccctgggaataattgcatatataacttgtgtttggagaatcacatgaactttaatcagggtaatagcactttcaaacttgctagtagattttactgtaggtgtaatgccttaatcatctttttgaatgttttctcagagctggaggttgctgggcacctaaatgatgtttcatgatagctttgggtgattttactgctatttataatttgctgtataaagtgagcattacttaatttgcaagctgatttctcacagtgtaaatttgttcattcctggtagtctattttctataaaaatgtatttttgcacaacatttttaaaaactggtgtaccttcatctatgacgtgttccattttgacaaacagctttcaggcgtaaatccagagaagtgctttatatgaaatgtattattttgaacagagtttgtgatttggtagttattttatgttgttgaaatttgaatttcacaattcttagataattatttcaaatggatattgatgcattcttgttaccagatgtttggcccattccattttgatgaaacagagctgttgttttggaagtcattatttttctagaaatggcgaatcttttaaagaaaattacttaatggaaggttgtgggaaggtgtttttttgtgtttttttttttggtttttgttttgtttttcctcttttaagggatagtagcaggtcttacttgaatgaaagtctgatatttgctgatggcagaatgattattctgtaccctggttgatgtgtagagtagattgtctggtgctctcagttgtttttatttacatttgtcacgttgttgtaagagaatgttaacatggtataaaactctgtgacaagataagcctcctgctttatataacttcttgaatccagctaagagatttataaactaatggcataaatgtctggagccaaccttggcagttatagcaggagaacactgtcttaatatttctttacattctttcaaaaggcaaaataggattgccctgtattgatgtagaaatgtctgtaaacagagcttgtatggtttgctgggtcaaacaatgtttccaacttaaaatcaatctcattgccactttaactacttttagtcatatttattaagtaatgcagtttgtactttttttattttgtaacattttgtgatttttttgtacaaaactgtatttgtacaatagagcaattcccagctgatggaatgaatgaataaaatgcaaaattatacttttacaatgcctttttggatagagtggtttttaaattgtgatgtttgtaggaaactttcttgcatgtatgcatgtacacaattttttttttccataaagatgccacagcaatagagaggtttcctaaattatcacatgaagaggataggctaatcatgagtaatttcaaaggataagtctgaataaaatataatttaaaagtggagta

SEQ ID NO: 449756 - DNA, 1143 bp, Homo sapiens
  misc_feature (14)..(14): n is a, c, g, or t
ctccagaggacccncaggaaacagctatacgtgttccattttgacaaacagctttcaggcgtaaatccagagaagtgctttatatgaaatgtattattttgaacagagtttgtgatttggtagttattttatgttgttgaaatttgaatttcacaattcttagataattatttcaaatggatattgatgcattcttgttaccagatgtttggcccattccattttgatgaaacagagctgttgttttggaagtcattatttttctagaaatggcgaatcttttaaagaaaattacttaatggaaggttgtgggaaggtgtttttttgtgtttttttttttggtttttgttttgtttttcctcttttaagggatagtagcaggtcttacttgaatgaaagtctgatatttgctgatggcagaatgattattctgtaccctggttgatgtgtagagtagattgtctggtgctctcagttgtttttatttacatttgtcacgttgttgtaagagaatgttaacatggtataaaactctgtgacaagataagcctcctgctttatataacttcttgaatccagctaagagatttataaactaatggcataaatgtctggagccaaccttggcagttatagcaggagaacactgtcttaatatttctttacattctttcaaaaggcaaaataggattgccctgtattgatgtagaaatgtctgtaaacagagcttgtatggtttgctgggtcaaacaatgtttccaacttaaaatcaatctcattgccactttaactacttttagtcatatttattaagtaatgcagtttgtactttttttattttgtaacattttgtgatttttttgtacaaaactgtatttgtacaatagagcaattcccagctgatggaatgaatgaataaaatgcaaaattatacttttacaatgcctttttggatagagtggtttttaaattgtgatgtttgtaggaaactttcttgcatgtatgcatgtacacaattttttttttccataaagatgccacagcaatagagaggtttcctaaattatcacatgaagaggataggctaatcatgagtaatttcaaaggataagtctgaataaaatataatttaaaagtggagta

SEQ ID NO: 449757 - DNA, 1885 bp, Homo sapiens
gcggccgctgcctcctgctcgccccggcgcccgcagccccggtcccgccgcggcggggctcctcggcctggctcctggaggagctgctgcggcccgactgccccgagcccgcgggcttggacgcgacacgggaggggcccgatcggaacttccgactgagcgagcaccgccaggccctggccgccgccaagcaccgaggccccgcggcgaccccggggagccccgatcccggccccggtccgtggggcgaagagcacttggcggagaggggccccaggggctgggagaggggcggcgatcgctgcgacgcgcccggtggggacgcggcgcggaggcccgacccagaggccgaggcaccccccgccgggagcatcgaggccgccccgagtagtgcggcggagccggtgatcgtctccaggtcggatcccagagacgagaagctggccctatacctggccgaggtggagaagcaggacaagtatctgcggcagaggaataagtaccgattccacatcattccagacggcaactgcctctaccgagctgtcagcaagacggtgtatggggaccagagcctgcaccgggagttgagggagcagacggtgcactacatcgccgaccatttcaaccacttcagccccctgattgagggcgacgtgggggagtttatcatcgctgctgcccaagacggggcatgggccgggtacccggagttgctggccatggggcagatgctgaatgtgaatatccatttaactactggagggaggctggagagtcccacggtgtctaccatgattcattatttgggcccagaggattccctgaggcctagtatttggctcagttggctcagtaacggacactatgatgctgtatttgatcactcctatcctaacccagagtacgacaactggtgcaaacaaactcaagtgcaaaggaaacgcgacgaagaacttgccaaatctatggccatatccttgtctaaaatgtatattgaacaaaatgcatgctcttgaaatgtctcaaaaccttacaccctgggaataattgcatatataacttgtgtttggagaatcacatgaactttaatcagggtaatagcactttcaaacttgctagtagattttactgtaggtgtaatgccttaatcatctttttgaatgttttctcagagctggaggttgctgggcacctaaatgatgtttcatgatagctttgggtgattttactgctatttataatttgctgtataaagtgagcattacttaatttgcaagctgatttctcacagtgtaaatttgttcattcctggtagtctattttctataaaaatgtatttttgcacaacatttttaaaaactggtgtaccttcatctatgacgtgttccattttgacaaacagctttcaggcgtaaatccagagaagtgctttatatgaaatgtattattttgaacagagtttgtgatttggtagttattttatgttgttgaaatttgaatttcacaattcttagataattatttcaaatggatattgatgcattcttgttaccagatgtttggcccattccattttgatgaaacagagctgttgttttggaagtcattatttttctagaaatggcgaatcttttaaagaaaattacttaatggaaggttgtgggaaggtgtttttttgtgtttttttttttggtttttgttttgtttttcctcttttaagggatagtagcaggtcttacttgaatgaaagtctgatatttgctgatggcagaatgattattctgtaccctggttgatgtgtagagtagattgtctggtgctctcagttgtttttatttacatttgtcacgttgtatcagagatgccgcggtaccgagctgat

SEQ ID NO: 449758 - DNA, 2471 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449759 - DNA, 587 bp, Homo sapiens
atgccggtcgacactagaggccccccgctattacagatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccctccctccccctgcagaatcccagcggtcccataggggtaagtaagcctctaccaccctagcagta

SEQ ID NO: 449760 - DNA, 4767 bp, Homo sapiens
  misc_feature (4737)..(4737): n is a, c, g, or t
  misc_feature (4740)..(4740): n is a, c, g, or t
  misc_feature (4747)..(4747): n is a, c, g, or t
  misc_feature (4749)..(4749): n is a, c, g, or t
  misc_feature (4753)..(4753): n is a, c, g, or t
  misc_feature (4757)..(4757): n is a, c, g, or t
  misc_feature (4761)..(4761): n is a, c, g, or t
  misc_feature (4764)..(4764): n is a, c, g, or t
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacaaaaaaaaaaaacaaaacaaaacaaaacacnaanaacacananaaanaaancaanaanaca

SEQ ID NO: 449761 - DNA, 4838 bp, Homo sapiens
  misc_feature (4808)..(4808): n is a, c, g, or t
  misc_feature (4811)..(4811): n is a, c, g, or t
  misc_feature (4818)..(4818): n is a, c, g, or t
  misc_feature (4820)..(4820): n is a, c, g, or t
  misc_feature (4824)..(4824): n is a, c, g, or t
  misc_feature (4828)..(4828): n is a, c, g, or t
  misc_feature (4832)..(4832): n is a, c, g, or t
  misc_feature (4835)..(4835): n is a, c, g, or t
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacaaaaaaaaaacaaaaacaagataaaaaaaaaaaaaaaaaaaaaaaaaaaaaaaaaaaaaaaacgaaaaacagaaaaaaaaaaacaaaacaaaacaaaacacnaanaacacananaaanaaancaanaanaca

SEQ ID NO: 449762 - DNA, 5209 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaaaaagggcggagggtgtgggaaaaggtttatttacccttaggggaaacgcggcgggaaatcgtggggggggggggagagaggggaacgggtttattctcccccgagtattcacctcttccatctattgaacaacaatatttatgcgtgtcccctgtgcgtgaactttattcttttggcgctggtacccataaacttgtgggtgggctgccccagtgattctcgggggggccactttctgcatcaaaatgtcgggtgggcggacacccaccaaaaaaagaaaacatcgaaaaaatagatacgaagaacagaaaaatctgttgtggcggggcccgcactcgccggcgcaccccggagaaagaaacgttttttctacaaaaaccaaccagtgtgtggtgggggcgacgagcgagcgacccccatgaaggaaatgagagcgacacacagtgggccaaccacgaggtgggtccccgcgagagagagacaccggctgggcacgaagcaacaaggaggggcggggggatggttctctccccccaagataaaaacaagcgccgccgggcgggaacacaagacgagagtcgtttctgtggcaacacaaacccatcgagagaggtggcatccgctggagggagccacaccagcggggggactcatcaacacgcaggaggggaccgccaaagcgaaccgctggttaaaaaaatagcgca

SEQ ID NO: 449763 - DNA, 4825 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggtacgtgccagcaggcatttcttgtgaggtctcccttccttttctccccttattccctcccccaagccagactgatctgccagtgccccttcatcttgcctgtgtttgcttttgcagggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449764 - DNA, 4196 bp, Homo sapiens
tgtgggtggcatctgacagtctggtgaggagaggtcaggaaggcttcccagagggacatgatggctcagctagacctctttggcttttggtactacttgtggcacagggtgttcaggtcggggaaccatgatagggttgcagaggagttcagaggccatggaggagtcagttctcaaaaaatcaaatgataccctcctcctgtctacattttcctgagaggattgaaacctgtgttctctctgccagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449765 - DNA, 4373 bp, Homo sapiens
taatttaattccatttcagctcaaaaggcaggagaatcgcttgggcctgggaggcggagattgcagtgagccgagactgtgccactgtattccatcctgggcaacacagcgagactccatatccaaaaaaaaaaaaaaaaggtggggcatgtgtgaaggttgctgaggaggtgatgtcctatgagcaaataggagcttatactcaaggtggaggaaacagcctctgcaaaggttgtaaagtcagaaggagcttgtgttggatggagaaattgaaagacctgaggattgcaaagtggctggcaagcagacgggtttggaatagacattggaagaagcttttagggcatcctagacagcgttgcgatgcttggggcaggggcaggaaaaagccactgatggactttcagggcagagctgtaatcgagttgatgtttcagatttagtcgaagggtgtgagagggctgagacggagaaagtggtgtggcagaagaggttgctggtggccatgggtcggggtgcagattatgagagaactctggccagtgactgctcacccggggcagcgttgagtccatcaacaccgttttggtctcttaacctgaggctagtggctgggcagtgagctaatcccaaagcttccgtctgtaccacagtcttggggtgctaccttgtccttatcacactctggggtaacttgaagcccttctcaaagatctcctgtgatgggactttccttaacttgactcacatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449766 - DNA, 3746 bp, Homo sapiens
atgccggtcgacactagaggccccccgctattacagatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449767 - DNA, 4469 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggtggaaggtcccttccaccagctactgaatcgtcgccttggtaggcttttaccctacacaagtagctaatcagctatcggccattccaatagcacaaggtccgaagatcccctgctttcatccacagatcgtatgcggaaatagctatccttacggatagttatcccccaatactgggtatgtgccgatatattataaccgtacgcaatgacacagaacg

SEQ ID NO: 449768 - DNA, 2549 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449769 - DNA, 4017 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagaaaatacagatttgttttttgtgacaaatggacattgtactctgtacttctgctgtaagtagtccttttccattttgtaatgactggtaacaaaacccaggccgggtggcaggaaagggcagtggtttcgagccctgggttttggagtcagccagacctgggttcaaatatggctcagccactgtcttgctttgtgactttgggccaaagtgtcttttaactgctcagttaaaagttaacaactcagtcttcttatctgtaaaatggggctgaaatatcagaacctacctcatagggttgttgtgaggaatttcagaagctgtgatgtctgtaaagcgcttagcccagtgcctgccacttaagcgctaagttaaaggcagtgattacgaactgctggggtcggggtggatctgcgccattgctgggtgtgggaatgtcgatgccttgttttttttctgttttgatatttttattttttctgcagtcaccggctgccaacataatctgcaccaactggagatcagaaacca

SEQ ID NO: 449770 - DNA, 3782 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccctgcagatttccagcgtttccattaaggttaagtaagccttttcaaaccttggcttttaaaaaa

SEQ ID NO: 449771 - DNA, 1508 bp, Homo sapiens
ctggccggccctccattagtgtaggccaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449772 - DNA, 1569 bp, Homo sapiens
ggctggtactggcccggaatttaaggatgcagctgcacattccccagagggcctgggagctgggctttctcccagggccagggtaggtgagagcacagaatctggccttgtccttcacagaacaaggccagccctttggtatgagcaggggaaggagagtgggcaccagctttgaggctcgggcttcatgcccgccgtaggtcagatcacaaaaggaggccccacagccctcgaggaagggagggcttgcagtttgcaggagctgggggctcagatcagcctgtgcagtcaggagggagggagagaccccaatttctgagtgagactcctaactgttttctctctccacagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449773 - DNA, 1266 bp, Homo sapiens
attcattactaataatgcatttttggagacttttgtgagagtggacagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449774 - DNA, 897 bp, Homo sapiens
agaggtgctgactgcagctactctccccaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449775 - DNA, 1425 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449776 - DNA, 1414 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggtgagggcagggggttcccctccgtggactcccgtggctcatgtgcccctgcccgccgcccgccgtgcaaattctcacccgtcctccctc

SEQ ID NO: 449777 - DNA, 1276 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatatcctttgctggaaaacaggtgttccttagggtagggactcttgcagggcttgacagtggccattctttgagccagcatgtgtctgctgaccacgggagtggctgccatgtgccagatgccttcacagagcccagtgactgagtagggaggcagttaaaggaccaggcatatcgtgtggacgtgcagatctt

SEQ ID NO: 449778 - DNA, 1187 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcaggtactgggctcagaggccaggtgttgggcttccaaagttgactcctgggtgtccttgtgtgtccacgatttctggttggaaatagtgattttgttgccatcctggtctagattctgtggccgctctgcttttgggttggccattgtactttgtgtcagattacagcaagttccatgaccctttttccttccttcgtttttcctctgccttgtagtttctagtcagtgttctctttttcagacagagcaaggtctcgctttgtggcccaggctggagtgtagtggtgcagtctcacccaggctcaggcagtccttctgcctcggcctgctgagtagctgggactataggcatgcgccaccatgcccggctaatttttacatatatatattttttgtttgtttgtttgttttgagactccctctcgctctg

SEQ ID NO: 449779 - DNA, 586 bp, Homo sapiens
cccggcagcaggtaactgtgtgcctctgagctgtttggctgtctggttttaggtctgaaatacagatttgttttttgtgacaaatggacattgtactctgtacttctgctgtaagtagtccttttccattttgtaatgactggtaacaaaacccaggccgggtggcaggaaagggcagtggtttcgagccctgggttttggagtcagccagacctgggttcaaatatggctcagccactgtcttgctttgtgactttgggccaaagtgtcttttaactgctcagttaaaagttaacaactcagtcttcttatctgtaaaatggggctgaaatatcagaacctacctcatagggttgttgtgaggaatttcagaagctgtgatgtctgtaaagcgcttagcccagtgcctgccacttaagcgctaagttaaaggcagtgattacgaactgctggggtcggggtggatctgcgccattgctgggtgtgggaatgtcgatgccttgttttttttctgttttgatatttttattttttctgcagtcaccggctgccaacataatctgcaccaactggagatcagaaacca

SEQ ID NO: 449780 - DNA, 326 bp, Homo sapiens
ggattctctatgggaatgaaggaagagaaggagaaacgccgtgcataattggtaattggctcatcttgaagcctcacgttgggcagtcactccttagacccctgccgttgacctgcagaaaatgggagatgggtacaaacttgaggggacctgggtttggggagcctccaaagacgggaaccaaccaaacttgtctctcctttgcagatggtccatacccttacactctgaagttgtgtttctccactgctcagcacgcctcctaattaggtgcctaggaagagtcccatctgagcaggaagacatttctctttcctttatgccat

SEQ ID NO: 449781 - DNA, 326 bp, Homo sapiens
ggttcaaatatggctcagccactgtcttgctttgtgactttgggccaaagtgtcttttaactgctcagttaaaagttaacaactcagtcttcttatctgtaaaatggggctgaaatatcagaacctacctcatagggttgttgtgaggaatttcagaagctgtgatgtctgtaaagcgcttagcccagtgcctgccacttaagcgctaagttaaaggcagtgattacgaactgctggggtcggggtggatctgcgccattgctgggtgtgggaatgtcgatgccttgtacatgattgcttatttgaactgattctgctgttgccct

SEQ ID NO: 449782 - DNA, 4707 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449783 - DNA, 4122 bp, Homo sapiens
ccagtgtctgctcttttcgatccgggacggccggtcaggctcgccgccgagctggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449784 - DNA, 4677 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtccccgtacatcgttagaagcttgaattcgagcagtagtagtagtaggcggccgc

SEQ ID NO: 449785 - DNA, 4038 bp, Homo sapiens
ggtcgtgccggaattcgtcgtggtcgtgccggaattggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449786 - DNA, 4204 bp, Homo sapiens
ttccgtgttcggggttgggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggtacgtgccagcaggcatttcttgtgaggtctcccttccttttctccccttattccctcccccaagccagactgatctgccagtgccccttcatcttgcctgtgtttgcttttgcagggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449787 - DNA, 3744 bp, Homo sapiens
ctggccggccctccattagtgtaggccaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449788 - DNA, 1886 bp, Homo sapiens
ccagtgtctgctcttttcgatccgggacggccggtcaggctcgccgccgagctggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449789 - DNA, 3790 bp, Homo sapiens
  misc_feature (3728)..(3728): n is a, c, g, or t
  misc_feature (3737)..(3737): n is a, c, g, or t
  misc_feature (3749)..(3749): n is a, c, g, or t
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagcccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctccccgtcttgcgngggctgccngccccccccaanacgcagcaattcactgtaaatatggaaagggacgaactggc

SEQ ID NO: 449790 - DNA, 1866 bp, Homo sapiens
agcggtattgagctggggcggcgttggtcggagggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449791 - DNA, 1842 bp, Homo sapiens
ccgcgatgccgagagctgtggtgtgggttgcagatgtggctcggatcctttgttgctgcggctatggtgtaggtcagcggctgcagctccaatttgacccctggcctgggaccctctatgtgctgtgggtgcagagctaaaaagacaaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagagtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449792 - DNA, 1182 bp, Homo sapiens
gctttctcgtgttacatcgcgagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacgcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449793 - DNA, 1192 bp, Homo sapiens
agaggtgctgactgcagctactctccccaaggtgaaattcatgaaaagcaagccgggggccgccatggtggagatggctgatggctacgctgtagaccgggccattacccacctcaacaacaacttcatgtttgggcagaagctgaatgtctggtaggtgctcaggctcgggagggcagcagaggtacaggggagagaaaaggaggggaatggggcccagcagaggagcacagtgaggccgaggtgttgactcacacagaaatgggatgtggcaggtgtgttcccagacgtgtctctgacaccacaggagaaagtgagtcagccttgcctcaggtgtagagcaatgccccaaggcacacagggcaagctaagcctctggaggccacaggggaaagcttcagggacaactttgggtatgacaaaggctcccctttcttccttgctgcagtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449794 - DNA, 703 bp, Homo sapiens
aaaggtgataactcttctatgataggggaagtagcgtcgttgtaacctacttgcgctgatatgccagttcttgctgagcaagaatggcatatcagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacaca

SEQ ID NO: 449795 - DNA, 1394 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggtacgtgccagcaggcatttcttgtgaggtctcccttccttttctccccttattccctcccccaagccagactgatctgccagtgccccttcatcttgcctgtgtttgcttttgcagggatgttctttacactatctgtaatccttgtggccctgtccagagaattgtcattttcaggaagaatggagttcaggcgatggtggaatatcctttgctggaaaacaggtgttccttagggtagggactcttgcagggcttgacagtggccattctttgagccagcatgtgtctgctgaccacgggagtggctgccatgtgccagatgccttcacagagcccagtgactgagtagggaggcagttaaaggaccaggcatatcgtgtggacgtgcagatctt

SEQ ID NO: 449796 - DNA, 765 bp, Homo sapiens
caccccagcaacgtgctgcacttcttcaacgccccgctggaggtgaccgaggagaacttctttgaggtgtgtgccgtggagctgcgcaggcagtcgggtccttgccacggccgtctgagtaggccattcatttcagtcttttctgcaaatagctgttgaactcctgtcctgcctggccctgggttgagtgctagggacacagcagaggccaggacagataggaatctgtgctctcaaactggacagggtgagaatggcaccaagtttctagcaacaccatttgccgcgttccttccttttacatttttggcaagcagggcaactgctcgtttgctgggaaagctgcttcacaggcccagtgatgagggcccaatttcacaagaaccgcattggcgtaggcttcgggtgccatcaccctgataccatcagaaggtggggccctgtaaagctcagtcagggggaactgaggcagcggaagggaggaggaactcaagtggatctggctgtggtctgaaatgttgaccttgcattcagcaaacagtgttcagcaaacagccgggtgcagatatccacatagctgttgaagttgggaacgaaaaagcagcttcccagtctcaggcaacttaataattaaagagcattgttgctggcctttttatgacacagggatgccttagggtatgtgataaaatctacaagccttttctcctgaaaacttcaagtactgagtcatgcagggcctggtctgcttgaatcctgtgtggc

SEQ ID NO: 449797 - DNA, 2753 bp, Homo sapiens
aggttactatagtgtctgctcctacccctgggacaagatcccctaatgagctggcaggtgggcgtggggggcacaggtacagcttggcttctcagctttgctcccctatcctctgctttgccatgaatctctcatccagccccgcagggatctgcctggccagcagtgagcctgagcccctttcatcctgggacctgccgaccacggctcacatcctcctgggtgaagaatgtcaccttgcttcctatctgcctctttcgtggttggctggggagggggaccggggggtggggtgaggttaacctcattgttgtcttatatggtcatttaaatctcccagggcttcctccaagggccaaaaataatccggagacacagcagctgtgtccagcacacagaggacccggccatctgctttggttcagagccctgtgtctgtcagtcagtctctccctggctctccctccatcctcattcctgcctgaagccatgacccgcttctcctatgcagagtacttttccctctttcactcctgctctgcaccctccaggtccactgcacctcctgagagttcgccggcccgggccccaatgggcttgttccaaggggtcatgcagaaatacagcagcagcttgttcaagacctcccagctggcgcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgtgagcgcaagaacgcggaggccgtgaagattctggtgcagcacaacgcagacaccaaccaccgctgcaaccgcggctggaccgctctgcacgagtctgtgtctcgcaatgacctggaggtcatgcagatcctggtgagcggaggagccaaggtggaatccaagaatgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcgcccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaggactgggccgtcatcaaggagaaggcagaacctccaagacctctggctcacctttgccgactgcgggttcgaaaggccattgggaaataccgtataaaactcctagacaccttgccgctcccaggcaggctgattagatacctgaaatacgagaacacccagtaactggggccacggggagagaggagtagcccctcagactcttcttactaagtctcaggacgtcggtgttcccaactccaaggggacctggtgacagacgaggctgcaggctgcctccctctcagcctggacagctaccaggatctcactgggtctcagggcccagagctttggccagagcagagaacagaatgtgtcaaggagaagaatcatttgtttacaaactgatgagcagatcccagaccttctctaccttcaggaatggcagaaacctctattcctggggccagggcagagcttgaggtgttctggggaaggtggtgctcagagccttccctgtgcccctccacttgttctggaaaactcaccacttgacttcagagctttctctccaaagactaagatgaagacgtggcccaaggtagggggtagggggagcctgggtcttggagggctttgttaagtattaatataataaatgttacacatgtgaaaaaaaaaag

SEQ ID NO: 449798 - DNA, 1000 bp, Homo sapiens
aggttactatagtgtctgctcctacccctgggacaagatcccctaatgagctggcaggtgggcgtggggggcacaggtacagcttggcttctcagctttgctcccctatcctctgctttgccatgaatctctcatccagccccgcagggatctgcctggccagcagtgagcctgagcccctttcatcctgggacctgccgaccacggctcacatcctcctgggtgaagaatgtcaccttgcttcctatctgcctctttcgtggttggctggggagggggaccggggggtggggtgaggttaacctcattgttgtcttatatggtcatttaaatctcccagggcttcctccaagggccaaaaataatccggagacacagcagctgtgtccagcacacagaggacccggccatctgctttggttcagagccctgtgtctgtcagtcagtctctccctggctctccctccatcctcattcctgcctgaagccatgacccgcttctcctatgcagagtacttttccctctttcactcctgctctgcaccctccaggtccactgcacctcctgagagttcgccggcccgggccccaatgggcttgttccaaggggtcatgcagaaatacagcagcactaccaggatctcactgggtctcagggcccagagctttggccagagcagagaacagaatgtgtcaaggagaagaatcatttgtttacaaactgatgagcagatcccagaccttctctaccttcaggaatggcagaaacctctattcctggggccagggcagagcttgaggtgttctggggaaggtggtgctcagagccttccctgtgcccctccacttgttctggaaaactcaccacttgacttcagagctttctctccaaagactaagatgaagacgtggcccaaggtagggggtagggggagcctgggtcttggagggctttgttaagtattaatataataaatgttacacatgtgaaaaaaaaaag

SEQ ID NO: 449799 - DNA, 2569 bp, Homo sapiens
agctggggtccctttggagacactccaggaaaaggggggcacatacccccactgggcttttcctgatgctgacaggggctgctctggctgttcctaagtggaactcgtcaaggtggcagtgacggtgctgatggggacctcaggacttatctgatcagtttcccatcgtccttgctgggtctgttgcttcaccggcatctgtgctctgacaccattaataaccacagagtctgagagtcaggaggaagtgctgctcacactggaggaagtggctgggagagtgcaggggctggtggcagagaccgcccagagcccatcctagcccaacatggcgtgggtgtcctgggaatgaggcctgcctccagcctcaccttctccatctgggaaatgggactattgatgcagaagcctccccaaaagtggatctgagaggcatagacatcgtggttctcacggactctccaaggatgaggcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgtgagcgcaagaacgcggaggccgtgaagattctggtgcagcacaacgcagacaccaaccaccgctgcaaccgcggctggaccgctctgcacgagtctgtgtctcgcaatgacctggaggtcatgcagatcctggtgagcggaggagccaaggtggaatccaagaatgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcgcccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaggactgggccgtcatcaaggagaaggcagaacctccaagacctctggctcacctttgccgactgcgggttcgaaaggccattgggaaataccgtataaaactcctagacaccttgccgctcccaggcaggctgattagatacctgaaatacgagaacacccagtaactggggccacggggagagaggagtagcccctcagactcttcttactaagtctcaggacgtcggtgttcccaactccaaggggacctggtgacagacgaggctgcaggctgcctccctctcagcctggacagctaccaggatctcactgggtctcagggcccagagctttggccagagcagagaacagaatgtgtcaaggagaagaatcatttgtttacaaactgatgagcagatcccagaccttctctaccttcaggaatggcagaaacctctattcctggggccagggcagagcttgaggtgttctggggaaggtggtgctcagagccttccctgtgcccctccacttgttctggaaaactcaccacttgacttcagagctttctctccaaagactaagatgaagacgtggcccaaggtagggggtagggggagcctgggtcttggagggctttgttaagtattaatataataaatgttacacatgtgaaaaaaaaaag

SEQ ID NO: 449800 - DNA, 2275 bp, Homo sapiens
aggttactatagtgtctgctcctacccctgggacaagatcccctaatgagctggcaggtgggcgtggggggcacaggtacagcttggcttctcagctttgctcccctatcctctgctttgccatgaatctctcatccagccccgcagggatctgcctggccagcagtgagcctgagcccctttcatcctgggacctgccgaccacggctcacatcctcctgggtgaagaatgtcaccttgcttcctatctgcctctttcgtggttggctggggagggggaccggggggtggggtgaggttaacctcattgttgtcttatatggtcatttaaatctcccagggcttcctccaagggccaaaaataatccggagacacagcagctgtgtccagcacacagaggacccggccatctgctttggttcagagccctgtgtctgtcagtcagtctctccctggctctccctccatcctcattcctgcctgaagccatgacccgcttctcctatgcagagtacttttccctctttcactcctgctctgcaccctccaggtccactgcacctcctgagagttcgccggcccgggccccaatgggcttgttccaaggggtcatgcagaaatacagcagcagcttgttcaagacctcccagctggcgcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgtgagcgcaagaacgcggaggccgtgaagattctggtgcagcacaacgcagacaccaaccaccgctgcaaccgcggctggaccgctctgcacgagtctgtgtctcgcaatgacctggaggtcatgcagatcctggtgagcggaggagccaaggtggaatccaagaatgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcgcccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaggactgggccgtcatcaaggagaaggcagctccacttgttctggaaaactcaccacttgacttcagagctttctctccaaagactaagatgaagacgtggcccaaggtagggggtagggggagcctgggtcttggagggctttgttaagtattaatataataaatgttacacatgtgaaaaaaaaaag

SEQ ID NO: 449801 - DNA, 615 bp, Homo sapiens
agccgagcctggcgcccgagctctcctgctggcggggccggccctacccgtccacaccccgaccctcccctcacccgcgcccgcccctcgacccggcaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcgcccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccag

SEQ ID NO: 449802 - DNA, 1970 bp, Homo sapiens
agctggggtccctttggagacactccaggaaaaggggggcacatacccccactgggcttttcctgatgctgacaggggctgctctggctgttcctaagtggaactcgtcaaggtggcagtgacggtgctgatggggacctcaggacttatctgatcagtttcccatcgtccttgctgggtctgttgcttcaccggcatctgtgctctgacaccattaataaccacagagtctgagagtcaggaggaagtgctgctcacactggaggaagtggctgggagagtgcaggggctggtggcagagaccgcccagagcccatcctagcccaacatggcgtgggtgtcctgggaatgaggcctgcctccagcctcaccttctccatctgggaaatgggactattgatgcagaagcctccccaaaagtggatctgagaggcatagacatcgtggttctcacggactctccaaggatgaggcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgtgagcgcaagaacgcggaggccgtgaagattctggtgcagcacaacgcagacaccaaccaccgctgcaaccgcggctggaccgctctgcacgagtctgtgtctcgcaatgacctggaggtcatgcagatcctggtgagcggaggagccaaggtggaatccaagaatgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcgcccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaggactgggtcttggagggctttgttaagtattaatataataaatgttacacatgtgaaaaaaaaaag

SEQ ID NO: 449803 - DNA, 2333 bp, Homo sapiens
aggttactatagtgtctgctcctacccctgggacaagatcccctaatgagctggcaggtgggcgtggggggcacaggtacagcttggcttctcagctttgctcccctatcctctgctttgccatgaatctctcatccagccccgcagggatctgcctggccagcagtgagcctgagcccctttcatcctgggacctgccgaccacggctcacatcctcctgggtgaagaatgtcaccttgcttcctatctgcctctttcgtggttggctggggagggggaccggggggtggggtgaggttaacctcattgttgtcttatatggtcatttaaatctcccagggcttcctccaagggccaaaaataatccggagacacagcagctgtgtccagcacacagaggacccggccatctgctttggttcagagccctgtgtctgtcagtcagtctctccctggctctccctccatcctcattcctgcctgaagccatgacccgcttctcctatgcagagtacttttccctctttcactcctgctctgcaccctccaggtccactgcacctcctgagagttcgccggcccgggccccaatgggcttgttccaaggggtcatgcagaaatacagcagcagcttgttcaagacctcccagctggcgcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgtgagcgcaagaacgcggaggccgtgaagattctggtgcagcacaacgcagacaccaaccaccgctgcaaccgcggctggaccgctctgcacgagtctgtgtctcgcaatgacctggaggtcatgcagatcctggtgagcggaggagccaaggtggaatccaagaatgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcgcccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaggactgggccgtcatcaaggagaaggcagaacctccaagacctctggctcacctttgccgactgcgggttcgaaaggccattgggaaataccgtataaaactcctagacaccttgccgctcccaggcaggctgattagatacctgaaatacgagaacacccaaggtagggggtagggggagcctgggtcttggagggctttgttaagtattaatataataaatgttacacatgtgaaaaaaaaaag

SEQ ID NO: 449804 - DNA, 1526 bp, Homo sapiens
aggttactatagtgtctgctcctacccctgggacaagatcccctaatgagctggcaggtgggcgtggggggcacaggtacagcttggcttctcagctttgctcccctatcctctgctttgccatgaatctctcatccagccccgcagggatctgcctggccagcagtgagcctgagcccctttcatcctgggacctgccgaccacggctcacatcctcctgggtgaagaatgtcaccttgcttcctatctgcctctttcgtggttggctggggagggggaccggggggtggggtgaggttaacctcattgttgtcttatatggtcatttaaatctcccagggcttcctccaagggccaaaaataatccggagacacagcagctgtgtccagcacacagaggacccggccatctgctttggttcagagccctgtgtctgtcagtcagtctctccctggctctccctccatcctcattcctgcctgaagccatgacccgcttctcctatgcagagtacttttccctctttcactcctgctctgcaccctccaggtccactgcacctcctgagagttcgccggcccgggccccaatgggcttgttccaaggggtcatgcagaaatacagcagcagcttgttcaagacctcccagctggcgcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgtgagcgcaagaacgcggaggccgtgaagattctggtgcagcacaacgcagacaccaaccaccgctgcaaccgcggctggaccgctctgcacgagtctgtgtctcgcaatgacctggaggtcatgcagatcctggtgagcggaggagccaaggtggaatccaagaatgcctacggcatcacccccttgttcgtggccgcccagagtggacagttggaggccttgaggttcttagccaagtacggtgagtggctaagggtccctaggtcatggagtccccaaagggcacacgggaaggatgtcagaggtcagctctaagggaaggcgagttaggggtcatcttgtgcgcacactgatggagtgagagtttcctcctagagtgctgtgttgagaaagatgctgaggctgtgtccaggctcagtgggaagagcgtcgggatccactagtgacatctgccattagaacaaatatgggggggtctggcccacggaccacctatttgccatttataatctagtccaacattttcattttacaaacgagga

SEQ ID NO: 449805 - DNA, 161 bp, Homo sapiens
gtgagctcaggctgtcatttgcagacaaaacaagaaaaagaaatactgactgctcttgttcgtgatgccacaaagagaagtaatactgattactgaataaatagactgaaagtcagaatagctgttgaactaaataggaatcatggcgttagtgtcctgac

SEQ ID NO: 449806 - DNA, 15729 bp, Homo sapiens
ttctggtggtgatggggcttggcagggtcacctagcttggtagagacctccgcaagctgcttctctaagctgtatctctaacagtcattttcaatgtcatttcagcacttcccggagactggaccccaaggaacccctgggtaaccagagagcagcttccccaactccgaagcaggcttctgctaccactcctggccatgagagcccccgagagacaagggcacagggaccagcaggccaggaggctgatggtccccgcaggacgctgcaggtagacagcaggacacagagatcagggcggtccccctcagtgtcaccggacagaggcagcacccccacatcaccctactccgtccctcagatcgccccccttcccagcagcacgctgtgtcccatatgcaagacttcggacctcacgtcgacccccagccagccaaacttcaacacctgcacccagtgtcacaacaaggtctgcaaccagtgtgggttcaaccccaaccctcatctcacccaggtgaaggagtggctctgtctgaactgtcagatgcagagggctctgggaatggacatgaccactgcacctcgctccaagagccagcagcagctgcactccccagccctgtctcctgcccactccccggccaaacagcccctggggaagccagaccaagagagatctcggggcccaggaggaccacagcctgggtcccgccaggctgagacagccagggccacctcagtgccggggcctgcccaagcagctgcccctccagaggtggggagggtgtctcctcagccccctcaacccaccaagccttccacagctgagcccaggccacctgcaggagaggccccggccaaaagtgccaccgcagtgcccgctgggcttggtgccactgagcagacccaggagggcctcactggtaagctcttcggccttggcgcgtcactgctaacccaggcgagcaccctcatgtctgtgcagcccgaggctgacacccagggccagcctgcccccagcaaggggacacctaagatcgtcttcaatgatgccagcaaggaggctggcccaaaacccttgggctcagggcccgggcctgggccagcacctggagccaaaactgagcctggggctagaatgggtcctggatctggacctggagccctgccgaaaactgggggaacaaccagtccaaagcatggcagagcagaacatcaggcagcatcgaaggctgctgccaagccaaagaccatgccgaaggaaagggccatctgcccactgtgccaagccgagctcaacgtgggcagcaagagcccagccaactataacacatgcaccacctgcaggctccaggtgtgcaacctgtgtggcttcaacccaacaccccacctggtggagaaaacagagtggctctgtctgaactgccaaaccaagcggctactggagggcagcctaggagagccgacccccctgccgccgcccacctcacagcagccccctgtaggggcccctcaccgtgcatctggaacatcccctctgaagcagaaagggccacaggggctgggccagccttcaggccccctgcctgccaaggccagccctctatccaccaaggccagccctctgcccagcaaggccagcccccaggccaagcccctcagggcttctgaacccagcaagaccccaagcagtgtccaggaaaagaagacccgagtccccactaaagctgagcccatgccgaagccacctccagagactaccccaacccctgcgactcctaaagtaaagagtggggtgaggagggctgaacctgccacccctgtcgtcaaggctgttccagaagcccccaagggtggggaggcggaggacctggtgggcaagccttactctcaggatgcgtctcggagcccacagagcctcagtgacacaggctattcctctgacggcatctctagctcccagagtgagatcacaggagtcgtgcagcaggaggtggaacagctggacagtgcaggggtgacagggccacatccacccagcccctccgagatccacaaggtggggagcagcatgcggcctttgctgcaggcccagggcctggccccaagtgagcggagcaagccactctccagcggtactggcgaggagcagaagcagcggccccactccttgtccatcacgcctgaggcctttgactctgatgaggagctggaggatatcctggaggaagacgaagactctgctgagtggaggcgccggagagagcagcaggacactgccgagtcctcagacgactttggcagccaattgaggcacgactatgtggaggacagcagtgagggtggcctgtcccctcttccaccccagcccccagcccgggcagcagaactgactgatgaggatttcatgcgacggcagattctcgagatgagcgccgaggaagacaacctggaggaggatgacactgccacctccgggcgtggcctggccaaacatggcacccagaaaggtggccccagacccaggcctgagcctagccaagaaccagcagcactgcccaagaggcgcctgccccacaatgccaccacgggctatgaggagctgctccctgagggaggctcagcagaggctaccgatggcagtgggaccctgcagggtgggctccgtcgcttcaagaccattgagctcaacagcacgggaagttatggtcatgagttggacctgggccaaggcccagaccccagtctggaccgggagcctgagctggagatggagagcctaacgggctcccctgaggaccgctcccgtggtgagcactcctctacattgcctgcctccacacccagctacacctcgggcacctctcccacctctctgtcctccctagaggaggacagtgacagcagccccagccgcaggcagcgtctagaagaagcaaagcagcagcgcaaggcccggcaccgctcccacgggcccctgctacccaccatcgaggactcctcagaggaggaggagctgcgggaggaagaggagctgcttcgtgagcaagagaagatgcgggaggtggagcagcagcgcatccgcagcacagcccgcaagacccggcgggacaaggaagaactgcgggcccagcggaggcgagagcgctccaagacaccacccagtaacttgtcacccatcgaggatgcctccccgacggaggagctgaggcaggcggccgagatggaggagctacaccgctcctcctgctctgagtactcaccctcaccctcccttgactctgaggctgaggccttggatggtggccctagccggctttacaagtcaggcagtgagtacaacctgcccaccttcatgtccctctactcaccaaccgagacaccctccggcagctccaccactcccagttccggacggccgctcaagagcgctgaggaggcttatgaggagatgatgcgcaaagctgagctgctccagaggcagcaaggccaggcagcaggggcccggggaccccatggcggcccctctcagcccacaggcccccggggcctgggctccttcgaatatcaagacactacagaccgtgagtatggccaggctgctcagcctgccgcagagggcacgccagccagcctgggagcagccgtgtacgaagaaatccttcagacatcacagagcatagtccgcatgcggcaggcctcctcacgagacctggcttttgctgaggacaaaaagaaggagaagcagtttctaaatgctgagagtgcatacatggacccaatgaagcaaaatggtggcccccttacccctggtaccagtcccacccagctcgctgcccctgtgtccttctctacccccacctcctcagacagcagcgggggccgagttattcccgatgtccgtgtcactcagcattttgcaaaggagactcaggaccccctcaagctgcacagctctcctgcctcccccagctcagcctccaaggagataggcatgcccttttcccagggccctgggaccccagccaccacagctgtggctccttgtccagctgggctgccacgaggatatatgactccagcctccccagcaggctccgagcgtagtccttcaccatcttccacagcccacagctatggacacagcccaaccactgcaaactatgggtcccaaactgaggatctaccccaggcccccagtggccttgctgcagctggacgagctgctagagagaagcccttgagtgcgagtgacggtgagggtggcactcctcagccttcccgggcatattcctactttgcaagctccagcccacctctctccccgtcttccccctcagagagtcccacattctcccctggcaagatgggcccaagggccacagcagagttctctacacagacgccaagtccagcccctgcctcagacatgccacggagccctggtgcccccactccatcacctatggtagcccagggtacacaaacaccacatcgacccagcacgcctcgcctggtgtggcaggagtcctctcaagaggctccctttatggtcatcacgctggcatctgacgcctccagccagaccaggatggtacatgccagtgcctccacctccccgctctgctcacctactgaaacccagcccaccacccatggctacagccagacaacacctccgagtgtgtctcagctgcccccagagccacctgggccacctggctttccacgggtgcccagtgctggtgcagatgggcccctggcactatatggctggggtgccctccctgctgagaacatctccctgtgccggatctcctctgtccctgggacgtctagggttgagccaggccccaggacccctggcactgcagtggtagacctccgtacagctgtcaagcccactcccatcatcctcactgaccagggcatggacctcacctctcttgctgtggaagcgaggaagtatggtcttgccctggatccaatcccaggacggcagtcgaccgccgtgcagcccttggttatcaacctcaatgcccaggagcataccttccttgctactgccaccaccgtgagcatcaccatggcctcgtctgtgttcatggctcaacaaaagcagcctgtggtctatggagacccctaccagagccgccttgactttggccagggtgggggtagccctgtgtgcctggcccaggtcaaacaagtagagcaggctgtccagacagccccataccgaagtgggccccggggaagacccagggaggccaagtttgccagatataacctacccaaccaagtagctcctctggccagaagagacgttttgatcactcagatgggcaccgcccagagcattggcctcaagccaggcccagtgccagagccaggtgccgagccccaccgggccacccctgcagagctgcggtcacatgctctgccaggtgccaggaagccacacacagtggtggtgcagatgggagagggcacagcaggcactgtgaccacactgctcccagaggagcctgcgggtgccctggaccttaccgggatgaggcctgagagccagctggcatgctgtgacatggtctacaagctcccctttggcagcagctgcactggcaccttccacccggcccccagtgtgcctgagaagagcatggcagatgctgccccacctggccaaagcagcagccccttctatggtccccgggaccctgagcctcctgagcccccaacctaccgggcacagggggtggtggggcctgggccccatgaggagcagaggccctacccacaaggcctgcctggtaggctgtactcctccatgtctgacaccaatttggctgaggctggcctcaactaccatgcccagaggatcgggcagctcttccagggtcctggacgagactcggctatggacctcagctcactgaagcactcctacagcctgggctttgcggatggacgctacctagggcagggcttgcagtatggctcagtcacggacctgcgtcatcctacagaccttttggctcacccgcttcccatgcggcgctatagctcagtgtcgaacatctactcagaccacaggtacggcccacggggagatgcagttggcttccaggaggccagcctggcccagtacagtgccaccacagcccgtgaaatcagtcgcatgtgcgctgccctcaactccatggaccagtatggtgggcggcatggcagtggtggtggtggccctgaccttgtgcagtaccagccccagcacgggcccgggctcagtgctccacagagtctggttcccctcagacctggactccttggtaaccccacctttccagagggccacccaagtcctgggaacttggcccagtatgggcctgcagcaggccaaggaacagcagtcagacagctgctgccgtccacagccactgtacgtgcagctgatggcatgatctactcgactatcaataccccaattgctgcaacactgcccatcaccacccagcctgcctcagtcctgcggcccatggtgcgtggtggcatgtacaggccttacgcatctggtggaatcacagccgtgccactcaccagtctgacacgtgtgcccatgattgccccccgggtacctcttggacccacagggctgtaccgctatcctgcaccaagtagatttcccattgcttccagtgttccacctgcagaagggcctgtctatctggggaaacctgctgctgccaaggcccctggggctgggggcccttcaaggccagagatgccagtaggggctgcacgggaagagcctcttcccacaaccacccctgctgccatcaaggaggctgcaggagccccagctcctgccccactagctggccagaagccaccagcagatgctgctcctgggggtggcagtggggccctcagccggccagggttcgagaaagaggaagcatcacaggaggagaggcagcggaagcaacaggagcagctgctccagctagagcgggagcgggtggagttggagaagctgcgacaacttcggctgcaagaggagctagagcgggaacgtgtggagctgcagaggcaccgtgaggaggagcagctgctggtgcagcgggagttgcaggagctgcagaccatcaagcaccatgtgctgcagcagcagcaagaggaacgccaggctcaatttgcactgcagcgggaacagctagcgcagcagcgtctgcagctggagcagatccagcagctgcagcagcagctgcagcagcagctagaggagcagaagcagcggcagaaggctccctttcctgcagcctgtgaggcacctggccgagggcctcccctagcggctgctgagttggcccagaatggccagtattggcccccccttacacatgcagccttcattgccatggcagggcctgaaggacttgggcagcctcgtgagcctgtgctgcaccggggtctccccagctctgcctcagacatgtcactgcaaacggaggagcagtgggaggccagccgtagtggcatcaagaagcggcactccatgccacgcctgcgggatgcctgtgagctagagtctgggactgagccctgtgtggtcaggaggattgccgacagcagcgtgcagacagacgatgaggatggggagagccgctacctcttgagtcggcgacgccgggcacggcggagtgctgactgcagtgtgcagacggacgacgaagacagtgctgagtgggagcagccagtgcgccgccgcaggtctcgtcttccccgccactcagactcaggctctgacagcaagcacgatgccactgcctcatcatccagtgctgctgccactgtgagggccatgagcagcgtgggcatccagaccatcagtgactgctccgtgcagacggagcctgaccagctgcccagggtctctccagccatccacatcacagctgccaccgatcccaaggtggagatcgtcaggtacatatcggcgccagagaagactgggcgtggggagagcctggcctgccagacggagccagatgggcaggcccagggtgtagccgggccgcagcttgtagggccaactgccatcagcccctacctgcctggcatccagatcgtcaccccagggcctctgggcagatttgaaaaaaagaagccagatcccctggagattgggtaccaggcccacctgcctccggagtctctctcacagcttgtgagccgccagcctcccaagtcccctcaggtcctctactcaccagtctcacccctgtcccctcaccggctcctggacacctcctttgcttccagtgagaggctgaacaaagctcacgtgagtccccagaagcacttcacggctgacagcgctctccgccagcagacgctgcctcgccccatgaagaccctgcagcggtccctgtctgaccctaagcccctcagccccaccgccgaagagtctgccaaagagagattctccctctaccagcaccaggggggactgggtagccaggtgtcggcgttgccacccaacagcctggtccgcaaggtgaagcggacactgcccagcccccctccagaggaggctcaccttcccctggctggccaggcctccccacagctgtatgcagccagcctgctgcagcgagggctgacggggcccaccactgtccctgctaccaaggccagcctgctccgggagctggaccgggacctgcggctggtggagcatgagtccaccaaactgcgcaagaagcaggcagagctggatgaggaggagaaggagattgacgccaagctcaagtacctggagttgggtatcacacaacgcaaagagtctttggccaaagaccggggtggccgtgactacccacccttgcgtggtcttggcgagcatcgtgactacctatcggacagtgagctcaaccagctgcggctccagggctgcaccactcccgctggccagtttgtggacttccctgccactgccgctgctcctgccaccccctctggtcccactgccttccagcagccccgcttccagcctccagccccacagtattctgcaggcagtggtgggccaactcagaacggattcccagcccaccaggcccccacctaccctggccccagcacgtacccagctcctgcctttcctcctggtgccagttacccagctgagcctggcctgccaaaccagcaggctttccgccccacaggccactatgcaggccaaacacccatgccaaccacacagagcaccctttttccagtccccgctgatagccgtgccccactgcagaagccacgccagacatcgctagccgacttggagcagaaggtgcccaccaactatgaggtgatcgccagccccgttgtgcccatgtcttcagccccatctgaaaccagctacagtggcccagcagtgagcagcggctatgagcagggcaaggtccctgaggtgccccgggctggtgaccgtggcagtgtgagccagagcccagcccccacctacccctctgactcacactataccagtctggagcagaacgttcctcgaaactacgtaatgattgatgacatcagtgaactgaccaaggacagcacctctactgctcctgatagccaacggctggagcccctggggccaggcagcagtgggcgtccagggaaggagcctggagaaccaggtgtccttgacgggcccacactgccctgctgctatgccagaggagaagaggaatctgaggaggactcatacgatccccgcgggaagggtggccacctccggagcatggagagcaatggtcgaccagccagtacccactactatggtgacagtgactacaggcatggggctcgagtagagaagtatggtccagggcccatggggcccaagcatccctccaagagcctggctccagctgccatctcctcaaagcgcagcaagcaccggaagcagggcatggagcaaaagatatccaagttctcgcctattgaagaggccaaagacgtagagtcagacctggcgtcctaccccccacctgcagtcagcagcagcctggtctctcggggcaggaagttccaggatgaaatcacctatgggctcaagaagaacgtgtatgagcagcaaaaatactatgggatgtccagccgggacgcagtggaggacgaccgcatttatggcgggagcagccggtcccgggcaccttctgcatacagtggggagaagctgtccagccacgacttcagtggctggggcaaggggtacgaaagggaacgggaggctgtggagcgacttcaaaaagcgggccccaagccctcatccctaagtatggcccacagccgggtacgaccccccatgcggagccaggcctctgaagaggagagccccgtcagtcctttggggaggccccgccctgccggagggcccctccctcccggcggggatacctgcccacagttctgctccagccactccatgcctgatgtccaggaacatgtcaaggacggacctcgggcccacgcatataagcgtgaggagggctacatcctggatgattcccattgcgtggtttccgacagcgaagcgtatcacctgggccaggaggagacggactggtttgataagccccgggatgcccgctctgaccggttcaggcaccacgggggccatgcagtttcctcctcctcccagaagcgaggccctgccaggcacagctaccatgactacgatgaaccccctgaggagggcctgtggcctcatgatgagggtggcccaggccgccatgcctcagccaaggaacaccggcacggtgaccacgggcggcactcaggccgccacactggtgaggagccgggacggcgtgctgccaaaccacacgctcgggacctgggtcgccatgaggcccggccccactctcagcccagctctgctccagctatgccgaagaagggtcagcctgggtatcccagctctgctgagtactcacagccatcccgtgcttcatccgcataccatcatgcctctgacagcaagaagggctcccggcaagcccactccgggcccgctgcactgcagtcaaaggcagaaccccaggcgcagccgcagctgcaaggtcggcaggcagctccaggaccacagcagtcacagtcaccatcatccaggcaaataccctctggggcagcatcacgccagccacagacacagcagcagcagcaaggtcttgggctgcagcccccacagcaggctctgacacaggctcggctgcagcaacagagccagccaaccacccggggctcagcccctgctgccagccagcctgcagggaagcctcagccaggccccagcacagccacaggtcctcaaccagcaggaccgccacgggcagaacagacaaatggctctaaagggacagccaaagcaccgcaacaggggagggctcctcaggcccagccaacaccaggacctggacctgcaggtgtgaaggctggagccaggcctggaggaaccccaggggctcccgccggccagccaggtgccgatggggagagcgtgttctccaagatcctccctggcggggcagccgagcaagctggcaaactgacggaagctgtctctgcttttggcaaaaaattttcctcattctggtgaccatgcccagcatggctcttgaagaaatgaagagaggtatcattgctgtggaaaaatctctggagtcagaggcctgggcgcagctctggactctgcgtataacacatctacaatctggcaaacccttggcccaaagactcaccaggtgggacgtggcaggcaggcctcagttgaggacgtgatgttttctcacagcagctgcctgggtgaagcatctgctggacaagtcggaccactggccaggggacctttgattgtctttccagagatgctgctctctgcagggcaccaccttcaaggcacagcccttgttgggagggagaaccctctccagaaaccctgccaccatggtgtcttgccgtacttcccacagccgcctttttgcggcctggccggccaggcttcccgtgcgttatacacagagtttgggcacacactgccctccctccgagatgccagaagtttttccacagccttggagaggggctttgactgagggctgggggccctgggctccgtttccttcacattccagctggcccggatccctctgtggcacagggccctgcccgtcacatgccctctgggtgacatcggagcagacctccatgtggccaggggttgggagaactttacaaacattaggacctaacactgtctcatcgctgaaataagaggccatagcaccgaaaagcagcgtgggcgccggctgaggcttctcccagcccgtgggtggcagcgtgctagcacactgccaccatctcaaagccatccccctagccatcgtgagcatcccagcggcaccgccattgtctcaaccagccggctcctcgtctgtacacctggggatttcttttgatttcaagaacagccttaatcattccagtttgatttacgtgtatacctcataaacatttttcttttgtttctctctccccctttctctcttctcttggctcactcccttgcctctccccctccaccaccaccttgtgactgatggtttggtttcctctctgctctgcccctgctcagcacagggagaatgttgacttagaagcaatagggggcagcaggccaccaagagcacaaccccagggcgaggtctggggaggcctcccagcccgcctctgtttactgtgcaattccagtcgttcttaagccatcaccagtgggtgtactcagagcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggatagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggaggctcaaaggactgtgagccgggagatctgggctggagctagggggtcaatggatgctcaggaagagctgggcctttggcacttgtggtgagaacagttgacagtggtcatctggaactgttcatataaacagtggcttcaagctaagtttcttgtgaagtttctcaatagcaaatcttacagaaggtcctgtgtgaccctctctgcatctgtccccaggacctatgctccctgctcacccccttctccaaagcccaagcgtcccgctgctcatcagcttttttaccattgagccaggagtgcggcaggcagtacctgcctgacccttcaaggcctgaccttcgtccagagtgctctggtttgcaccatgcatttctcaggggtccgcatttctcatgcttttctataagatctacacaccccttcagagagggctcctcgctcacctctggtagctatggatgggacaggaagctgccaacctttgtgttggacttaacacccttgcctttctgggacttggcctcaccccacccatggaatacctgcctcatcccaaagatcaggtatgggctgaatgcagccatctgagcaagggctgagggaagccatcatctaacacctctggccacccaggaccaggtctgtgtggggatgtgccttggagaccaaggcaatagtcctttccactacaggccaggggatgggacaagaagtagggaacaggcagggaaatgttaggaggtcagcctccagcaggcctagtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttctccatacccctctccccagcatcatgagcaagggcattgcctcctctctctgctcacttcagggcccagtgcactcacttcacagtgacagccctcccctacaatccttgggcagagcatgtggtctgagggcccacagtgaaagaacagcagtggtggcaactatgccttgccttctggagcctgtagggagttttccaggcaggtcctttgccaggacagcatggtcctgccctgttgtcccgtctgctctcctcttacccacccccatgctgtaaatacttgtcatcatggactccaacagggttagagggacaggcctaatcaactgaaactcctcggagatgccatctctgtctccctgggtgccagcagccctgctgccatgtgcactggggtggcactggagagccatggcagtcgtgagatattgtatgtgtatgcacatgatcatgtgtgtatgtgcgtgcgtgcgtgtgtgtgtgtgtgtgtgtgtttctgcctcattcagtttctggggtcaaatcagctccttctctccaagtgcactaccctggagagtggtggccactcaataccttttcctctagctttcatgtcttgtttttgctttccccttcctcctccctctctccctttctttccttctctccttctttatttgaggggggaagagtgctgtacaaagtcaaacaaacaagtttacagttgtaagtgcaatgacccgagtcctccacatgaccttgtgaattgtgtgctgtccttctgtgctctgtgagaactcgtggtacttcagtgtccctccccctgtattgtgacaaggtaattctgtggtatcagaataaaaggacttgatataaacaacctaaagac

SEQ ID NO: 449807 - DNA, 14967 bp, Homo sapiens
ttctggtggtgatggggcttggcagggtcacctagcttggtagagacctccgcaagctgcttctctaagctgtatctctaacagtcattttcaatgtcatttcagcacttcccggagactggaccccaaggaacccctgggtaaccagagagcagcttccccaactccgaagcaggcttctgctaccactcctggccatgagagcccccgagagacaagggcacagggaccagcaggccaggaggctgatggtccccgcaggacgctgcaggtagacagcaggacacagagatcagggcggtccccctcagtgtcaccggacagaggcagcacccccacatcaccctactccgtccctcagatcgccccccttcccagcagcacgctgtgtcccatatgcaagacttcggacctcacgtcgacccccagccagccaaacttcaacacctgcacccagtgtcacaacaaggtctgcaaccagtgtgggttcaaccccaaccctcatctcacccaggtgaaggagtggctctgtctgaactgtcagatgcagagggctctgggaatggacatgaccactgcacctcgctccaagagccagcagcagctgcactccccagccctgtctcctgcccactccccggccaaacagcccctggggaagccagaccaagagagatctcggggcccaggaggaccacagcctgggtcccgccaggctgagacagccagggccacctcagtgccggggcctgcccaagcagctgcccctccagaggtggggagggtgtctcctcagccccctcaacccaccaagccttccacagctgagcccaggccacctgcaggagaggccccggccaaaagtgccaccgcagtgcccgctgggcttggtgccactgagcagacccaggagggcctcactggtaagctcttcggccttggcgcgtcactgctaacccaggcgagcaccctcatgtctgtgcagcccgaggctgacacccagggccagcctgcccccagcaaggggacacctaagatcgtcttcaatgatgccagcaaggaggctggcccaaaacccttgggctcagggcccgggcctgggccagcacctggagccaaaactgagcctggggctagaatgggtcctggatctggacctggagccctgccgaaaactgggggaacaaccagtccaaagcatggcagagcagaacatcaggcagcatcgaaggctgctgccaagccaaagaccatgccgaaggaaagggccatctgcccactgtgccaagccgagctcaacgtgggcagcaagagcccagccaactataacacatgcaccacctgcaggctccaggtgtgcaacctgtgtggcttcaacccaacaccccacctggtggagaaaacagagtggctctgtctgaactgccaaaccaagcggctactggagggcagcctaggagagccgacccccctgccgccgcccacctcacagcagccccctgtaggggcccctcaccgtgcatctggaacatcccctctgaagcagaaagggccacaggggctgggccagccttcaggccccctgcctgccaaggccagccctctatccaccaaggccagccctctgcccagcaaggccagcccccaggccaagcccctcagggcttctgaacccagcaagaccccaagcagtgtccaggaaaagaagacccgagtccccactaaagctgagcccatgccgaagccacctccagagactaccccaacccctgcgactcctaaagtaaagagtggggtgaggagggctgaacctgccacccctgtcgtcaaggctgttccagaagcccccaagggtggggaggcggaggacctggtgggcaagccttactctcaggatgcgtctcggagcccacagagcctcagtgacacaggctattcctctgacggcatctctagctcccagagtgagatcacaggagtcgtgcagcaggaggtggaacagctggacagtgcaggggtgacagggccacatccacccagcccctccgagatccacaaggtggggagcagcatgcggcctttgctgcaggcccagggcctggccccaagtgagcggagcaagccactctccagcggtactggcgaggagcagaagcagcggccccactccttgtccatcacgcctgaggcctttgactctgatgaggagctggaggatatcctggaggaagacgaagactctgctgagtggaggcgccggagagagcagcaggacactgccgagtcctcagacgactttggcagccaattgaggcacgactatgtggaggacagcagtgagggtggcctgtcccctcttccaccccagcccccagcccgggcagcagaactgactgatgaggatttcatgcgacggcagattctcgagatgagcgccgaggaagacaacctggaggaggatgacactgccacctccgggcgtggcctggccaaacatggcacccagaaaggtggccccagacccaggcctgagcctagccaagaaccagcagcactgcccaagaggcgcctgccccacaatgccaccacgggctatgaggagctgctccctgagggaggctcagcagaggctaccgatggcagtgggaccctgcagggtgggctccgtcgcttcaagaccattgagctcaacagcacgggaagttatggtcatgagttggacctgggccaaggcccagaccccagtctggaccgggagcctgagctggagatggagagcctaacgggctcccctgaggaccgctcccgtggtgagcactcctctacattgcctgcctccacacccagctacacctcgggcacctctcccacctctctgtcctccctagaggaggacagtgacagcagccccagccgcaggcagcgtctagaagaagcaaagcagcagcgcaaggcccggcaccgctcccacgggcccctgctacccaccatcgaggactcctcagaggaggaggagctgcgggaggaagaggagctgcttcgtgagcaagagaagatgcgggaggtggagcagcagcgcatccgcagcacagcccgcaagacccggcgggacaaggaagaactgcgggcccagcggaggcgagagcgctccaagacaccacccagtaacttgtcacccatcgaggatgcctccccgacggaggagctgaggcaggcggccgagatggaggagctacaccgctcctcctgctctgagtactcaccctcaccctcccttgactctgaggctgaggccttggatggtggccctagccggctttacaagtcaggcagtgagtacaacctgcccaccttcatgtccctctactcaccaaccgagacaccctccggcagctccaccactcccagttccggacggccgctcaagagcgctgaggaggcttatgaggagatgatgcgcaaagctgagctgctccagaggcagcaaggccaggcagcaggggcccggggaccccatggcggcccctctcagcccacaggcccccggggcctgggctccttcgaatatcaagacactacagaccgtgagtatggccaggctgctcagcctgccgcagagggcacgccagccagcctgggagcagccgtgtacgaagaaatccttcagacatcacagagcatagtccgcatgcggcaggcctcctcacgagacctggcttttgctgaggacaaaaagaaggagaagcagtttctaaatgctgagagtgcatacatggacccaatgaagcaaaatggtggcccccttacccctggtaccagtcccacccagctcgctgcccctgtgtccttctctacccccacctcctcagacagcagcgggggccgagttattcccgatgtccgtgtcactcagcattttgcaaaggagactcaggaccccctcaagctgcacagctctcctgcctcccccagctcagcctccaaggagataggcatgcccttttcccagggccctgggaccccagccaccacagctgtggctccttgtccagctgggctgccacgaggatatatgactccagcctccccagcaggctccgagcgtagtccttcaccatcttccacagcccacagctatggacacagcccaaccactgcaaactatgggtcccaaactgaggatctaccccaggcccccagtggccttgctgcagctggacgagctgctagagagaagcccttgagtgcgagtgacggtgagggtggcactcctcagccttcccgggcatattcctactttgcaagctccagcccacctctctccccgtcttccccctcagagagtcccacattctcccctggcaagatgggcccaagggccacagcagagttctctacacagacgccaagtccagcccctgcctcagacatgccacggagccctggtgcccccactccatcacctatggtagcccagggtacacaaacaccacatcgacccagcacgcctcgcctggtgtggcaggagtcctctcaagaggctccctttatggtcatcacgctggcatctgacgcctccagccagaccaggatggtacatgccagtgcctccacctccccgctctgctcacctactgaaacccagcccaccacccatggctacagccagacaacacctccgagtgtgtctcagctgcccccagagccacctgggccacctggctttccacgggtgcccagtgctggtgcagatgggcccctggcactatatggctggggtgccctccctgctgagaacatctccctgtgccggatctcctctgtccctgggacgtctagggttgagccaggccccaggacccctggcactgcagtggtagacctccgtacagctgtcaagcccactcccatcatcctcactgaccagggcatggacctcacctctcttgctgtggaagcgaggaagtatggtcttgccctggatccaatcccaggacggcagtcgaccgccgtgcagcccttggttatcaacctcaatgcccaggagcataccttccttgctactgccaccaccgtgagcatcaccatggcctcgtctgtgttcatggctcaacaaaagcagcctgtggtctatggagacccctaccagagccgccttgactttggccagggtgggggtagccctgtgtgcctggcccaggtcaaacaagtagagcaggctgtccagacagccccataccgaagtgggccccggggaagacccagggaggccaagtttgccagatataacctacccaaccaagtagctcctctggccagaagagacgttttgatcactcagatgggcaccgcccagagcattggcctcaagccaggcccagtgccagagccaggtgccgagccccaccgggccacccctgcagagctgcggtcacatgctctgccaggtgccaggaagccacacacagtggtggtgcagatgggagagggcacagcaggcactgtgaccacactgctcccagaggagcctgcgggtgccctggaccttaccgggatgaggcctgagagccagctggcatgctgtgacatggtctacaagctcccctttggcagcagctgcactggcaccttccacccggcccccagtgtgcctgagaagagcatggcagatgctgccccacctggccaaagcagcagccccttctatggtccccgggaccctgagcctcctgagcccccaacctaccgggcacagggggtggtggggcctgggccccatgaggagcagaggccctacccacaaggcctgcctggtaggctgtactcctccatgtctgacaccaatttggctgaggctggcctcaactaccatgcccagaggatcgggcagctcttccagggtcctggacgagactcggctatggacctcagctcactgaagcactcctacagcctgggctttgcggatggacgctacctagggcagggcttgcagtatggctcagtcacggacctgcgtcatcctacagaccttttggctcacccgcttcccatgcggcgctatagctcagtgtcgaacatctactcagaccacaggtacggcccacggggagatgcagttggcttccaggaggccagcctggcccagtacagtgccaccacagcccgtgaaatcagtcgcatgtgcgctgccctcaactccatggaccagtatggtgggcggcatggcagtggtggtggtggccctgaccttgtgcagtaccagccccagcacgggcccgggctcagtgctccacagagtctggttcccctcagacctggactccttggtaaccccacctttccagagggccacccaagtcctgggaacttggcccagtatgggcctgcagcaggccaaggaacagcagtcagacagctgctgccgtccacagccactgtacgtgcagctgatggcatgatctactcgactatcaataccccaattgctgcaacactgcccatcaccacccagcctgcctcagtcctgcggcccatggtgcgtggtggcatgtacaggccttacgcatctggtggaatcacagccgtgccactcaccagtctgacacgtgtgcccatgattgccccccgggtacctcttggacccacagggctgtaccgctatcctgcaccaagtagatttcccattgcttccagtgttccacctgcagaagggcctgtctatctggggaaacctgctgctgccaaggcccctggggctgggggcccttcaaggccagagatgccagtaggggctgcacgggaagagcctcttcccacaaccacccctgctgccatcaaggaggctgcaggagccccagctcctgccccactagctggccagaagccaccagcagatgctgctcctgggggtggcagtggggccctcagccggccagggttcgagaaagaggaagcatcacaggaggagaggcagcggaagcaacaggagcagctgctccagctagagcgggagcgggtggagttggagaagctgcgacaacttcggctgcaagaggagctagagcgggaacgtgtggagctgcagaggcaccgtgaggaggagcagctgctggtgcagcgggagttgcaggagctgcagaccatcaagcaccatgtgctgcagcagcagcaagaggaacgccaggctcaatttgcactgcagcgggaacagctagcgcagcagcgtctgcagctggagcagatccagcagctgcagcagcagctgcagcagcagctagaggagcagaagcagcggcagaaggctccctttcctgcagcctgtgaggcacctggccgagggcctcccctagcggctgctgagttggcccagaatggccagtattggcccccccttacacatgcagccttcattgccatggcagggcctgaaggacttgggcagcctcgtgagcctgtgctgcaccggggtctccccagctctgcctcagacatgtcactgcaaacggaggagcagtgggaggccagccgtagtggcatcaagaagcggcactccatgccacgcctgcgggatgcctgtgagctagagtctgggactgagccctgtgtggtcaggaggattgccgacagcagcgtgcagacagacgatgaggatggggagagccgctacctcttgagtcggcgacgccgggcacggcggagtgctgactgcagtgtgcagacggacgacgaagacagtgctgagtgggagcagccagtgcgccgccgcaggtctcgtcttccccgccactcagactcaggctctgacagcaagcacgatgccactgcctcatcatccagtgctgctgccactgtgagggccatgagcagcgtgggcatccagaccatcagtgactgctccgtgcagacggagcctgaccagctgcccagggtctctccagccatccacatcacagctgccaccgatcccaaggtggagatcgtcaggtacatatcggcgccagagaagactgggcgtggggagagcctggcctgccagacggagccagatgggcaggcccagggtgtagccgggccgcagcttgtagggccaactgccatcagcccctacctgcctggcatccagatcgtcaccccagggcctctgggcagatttgaaaaaaagaagccagatcccctggagattgggtaccaggcccacctgcctccggagtctctctcacagcttgtgagccgccagcctcccaagtcccctcaggtcctctactcaccagtctcacccctgtcccctcaccggctcctggacacctcctttgcttccagtgagaggctgaacaaagctcacgtgagtccccagaagcacttcacggctgacagcgctctccgccagcagacgctgcctcgccccatgaagaccctgcagcggtccctgtctgaccctaagcccctcagccccaccgccgaagagtctgccaaagagagattctccctctaccagcaccaggggggactgggtagccaggtgtcggcgttgccacccaacagcctggtccgcaaggtgaagcggacactgcccagcccccctccagaggaggctcaccttcccctggctggccaggcctccccacagctgtatgcagccagcctgctgcagcgagggctgacggggcccaccactgtccctgctaccaaggccagcctgctccgggagctggaccgggacctgcggctggtggagcatgagtccaccaaactgcgcaagaagcaggcagagctggatgaggaggagaaggagattgacgccaagctcaagtacctggagttgggtatcacacaacgcaaagagtctttggccaaagaccggggtggccgtgactacccacccttgcgtggtcttggcgagcatcgtgactacctatcggacagtgagctcaaccagctgcggctccagggctgcaccactcccgctggccagtttgtggacttccctgccactgccgctgctcctgccaccccctctggtcccactgccttccagcagccccgcttccagcctccagccccacagtattctgcaggcagtggtgggccaactcagaacggattcccagcccaccaggcccccacctaccctggccccagcacgtacccagctcctgcctttcctcctggtgccagttacccagctgagcctggcctgccaaaccagcaggctttccgccccacaggccactatgcaggccaaacacccatgccaaccacacagagcaccctttttccagtccccgctgatagccgtgccccactgcagaagccacgccagacatcgctagccgacttggagcagaaggtgcccaccaactatgaggtgatcgccagccccgttgtgcccatgtcttcagccccatctgaaaccagctacagtggcccagcagtgagcagcggctatgagcagggcaaggtccctgaggtgccccgggctggtgaccgtggcagtgtgagccagagcccagcccccacctacccctctgactcacactataccagtctggagcagaacgttcctcgaaactacgtaatgattgatgacatcagtgaactgaccaaggacagcacctctactgctcctgatagccaacggctggagcccctggggccaggcagcagtgggcgtccagggaaggagcctggagaaccaggtgtccttgacgggcccacactgccctgctgctatgccagaggagaagaggaatctgaggaggactcatacgatccccgcgggaagggtggccacctccggagcatggagagcaatggtcgaccagccagtacccactactatggtgacagtgactacaggcatggggctcgagtagagaagtatggtccagggcccatggggcccaagcatccctccaagagcctggctccagctgccatctcctcaaagcgcagcaagcaccggaagcagggcatggagcaaaagatatccaagttctcgcctattgaagaggccaaagacgtagagtcagacctggcgtcctaccccccacctgcagtcagcagcagcctggtctctcggggcaggaagttccaggatgaaatcacctatgggctcaagaagaacgtgtatgagcagcaaaaatactatgggatgtccagccgggacgcagtggaggacgaccgcatttatggcgggagcagccggtcccgggcaccttctgcatacagtggggagaagctgtccagccacgacttcagtggctggggcaaggggtacgaaagggaacgggaggctgtggagcgacttcaaaaagcgggccccaagccctcatccctaagtatggcccacagccgggtacgaccccccatgcggagccaggcctctgaagaggagagccccgtcagtcctttggggaggccccgccctgccggagggcccctccctcccggcggggatacctgcccacagttctgctccagccactccatgcctgatgtccaggaacatgtcaaggacggacctcgggcccacgcatataagcgtgaggagggctacatcctggatgattcccattgcgtggtttccgacagcgaagcgtatcacctgggccaggaggagacggactggtttgataagccccgggatgcccgctctgaccggttcaggcaccacgggggccatgcagtttcctcctcctcccagaagcgaggccctgccaggcacagctaccatgactacgatgaaccccctgaggagggcctgtggcctcatgatgagggtggcccaggccgccatgcctcagccaaggaacaccggcacggtgaccacgggcggcactcaggccgccacactggtgaggagccgggacggcgtgctgccaaaccacacgctcgggacctgggtcgccatgaggcccggccccactctcagcccagctctgctccagctatgccgaagaagggtcagcctgggtatcccagctctgctgagtactcacagccatcccgtgcttcatccgcataccatcatgcctctgacagcaagaagggctcccggcaagcccactccgggcccgctgcactgcagtcaaaggcagaaccccaggcgcagccgcagctgcaaggtcggcaggcagctccaggaccacagcagtcacagtcaccatcatccaggcaaataccctctggggcagcatcacgccagccacagacacagcagcagcagcaaggtcttgggctgcagcccccacagcaggctctgacacaggctcggctgcagcaacagagccagccaaccacccggggctcagcccctgctgccagccagcctgcagggaagcctcagccaggccccagcacagccacaggtcctcaaccagcaggaccgccacgggcagaacagacaaatggctctaaagggacagccaaagcaccgcaacaggggagggctcctcaggcccagccaacaccaggacctggacctgcaggtgtgaaggctggagccaggcctggaggaaccccaggggctcccgccggccagccaggtgccgatggggagagcgtgttctccaagatcctccctggcggggcagccgagcaagctggcaaactgacggaagctgtctctgcttttggcaaaaaattttcctcattctggtgaccatgcccagcatggctcttgaagaaatgaagagaggtatcattgctgtggaaaaatctctggagtcagaggcctgggcgcagctctggactctgcgtataacacatctacaatctggcaaacccttggcccaaagactcaccaggtgggacgtggcaggcaggcctcagttgaggacgtgatgttttctcacagcagctgcctgggtgaagcatctgctggacaagtcggaccactggccaggggacctttgattgtctttccagagatgctgctctctgcagggcaccaccttcaaggcacagcccttgttgggagggagaaccctctccagaaaccctgccaccatggtgtcttgccgtacttcccacagccgcctttttgcggcctggccggccaggcttcccgtgcgttatacacagagtttgggcacacactgccctccctccgagatgccagaagtttttccacagccttggagaggggctttgactgagggctgggggccctgggctccgtttccttcacattccagctggcccggatccctctgtggcacagggccctgcccgtcacatgccctctgggtgacatcggagcagacctccatgtggccaggggttgggagaactttacaaacattaggacctaacactgtctcatcgctgaaataagaggccatagcaccgaaaagcagcgtgggcgccggctgaggcttctcccagcccgtgggtggcagcgtgctagcacactgccaccatctcaaagccatccccctagccatcgtgagcatcccagcggcaccgccattgtctcaaccagccggctcctcgtctgtacacctggggatttcttttgatttcaagaacagccttaatcattccagtttgatttacgtgtatacctcataaacatttttcttttgtttctctctccccctttctctcttctcttggctcactcccttgcctctccccctccaccaccaccttgtgactgatggtttggtttcctctctgctctgcccctgctcagcacagggagaatgttgacttagaagcaatagggggcagcaggccaccaagagcacaaccccagggcgaggtctggggaggcctcccagcccgcctctgtttactgtgcaattccagtcgttcttaagccatcaccagtgggtgtactcagagcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggatagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggagggtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttctccatacccctctccccagcatcatgagcaagggcattgcctcctctctctgctcacttcagggcccagtgcactcacttcacagtgacagccctcccctacaatccttgggcagagcatgtggtctgagggcccacagtgaaagaacagcagtggtggcaactatgccttgccttctggagcctgtagggagttttccaggcaggtcctttgccaggacagcatggtcctgccctgttgtcccgtctgctctcctcttacccacccccatgctgtaaatacttgtcatcatggactccaacagggttagagggacaggcctaatcaactgaaactcctcggagatgccatctctgtctccctgggtgccagcagccctgctgccatgtgcactggggtggcactggagagccatggcagtcgtgagatattgtatgtgtatgcacatgatcatgtgtgtatgtgcgtgcgtgcgtgtgtgtgtgtgtgtgtgtgtttctgcctcattcagtttctggggtcaaatcagctccttctctccaagtgcactaccctggagagtggtggccactcaataccttttcctctagctttcatgtcttgtttttgctttccccttcctcctccctctctccctttctttccttctctccttctttatttgaggggggaagagtgctgtacaaagtcaaacaaacaagtttacagttgtaagtgcaatgacccgagtcctccacatgaccttgtgaattgtgtgctgtccttctgtgctctgtgagaactcgtggtacttcagtgtccctccccctgtattgtgacaaggtaattctgtggtatcagaataaaaggacttgatataaacaacctaaagac

SEQ ID NO: 449808 - DNA, 16042 bp, Homo sapiens
ttctggtggtgatggggcttggcagggtcacctagcttggtagagacctccgcaagctgcttctctaagctgtatctctaacagtcattttcaatgtcatttcagcacttcccggagactggaccccaaggaacccctgggtaaccagagagcagcttccccaactccgaagcaggcttctgctaccactcctggccatgagagcccccgagagacaagggcacagggaccagcaggccaggaggctgatggtccccgcaggacgctgcaggtagacagcaggacacagagatcagggcggtccccctcagtgtcaccggacagaggcagcacccccacatcaccctactccgtccctcagatcgccccccttcccagcagcacgctgtgtcccatatgcaagacttcggacctcacgtcgacccccagccagccaaacttcaacacctgcacccagtgtcacaacaaggtctgcaaccagtgtgggttcaaccccaaccctcatctcacccaggtgaaggagtggctctgtctgaactgtcagatgcagagggctctgggaatggacatgaccactgcacctcgctccaagagccagcagcagctgcactccccagccctgtctcctgcccactccccggccaaacagcccctggggaagccagaccaagagagatctcggggcccaggaggaccacagcctgggtcccgccaggctgagacagccagggccacctcagtgccggggcctgcccaagcagctgcccctccagaggtggggagggtgtctcctcagccccctcaacccaccaagccttccacagctgagcccaggccacctgcaggagaggccccggccaaaagtgccaccgcagtgcccgctgggcttggtgccactgagcagacccaggagggcctcactggtaagctcttcggccttggcgcgtcactgctaacccaggcgagcaccctcatgtctgtgcagcccgaggctgacacccagggccagcctgcccccagcaaggggacacctaagatcgtcttcaatgatgccagcaaggaggctggcccaaaacccttgggctcagggcccgggcctgggccagcacctggagccaaaactgagcctggggctagaatgggtcctggatctggacctggagccctgccgaaaactgggggaacaaccagtccaaagcatggcagagcagaacatcaggcagcatcgaaggctgctgccaagccaaagaccatgccgaaggaaagggccatctgcccactgtgccaagccgagctcaacgtgggcagcaagagcccagccaactataacacatgcaccacctgcaggctccaggtgtgcaacctgtgtggcttcaacccaacaccccacctggtggagaaaacagagtggctctgtctgaactgccaaaccaagcggctactggagggcagcctaggagagccgacccccctgccgccgcccacctcacagcagccccctgtaggggcccctcaccgtgcatctggaacatcccctctgaagcagaaagggccacaggggctgggccagccttcaggccccctgcctgccaaggccagccctctatccaccaaggccagccctctgcccagcaaggccagcccccaggccaagcccctcagggcttctgaacccagcaagaccccaagcagtgtccaggaaaagaagacccgagtccccactaaagctgagcccatgccgaagccacctccagagactaccccaacccctgcgactcctaaagtaaagagtggggtgaggagggctgaacctgccacccctgtcgtcaaggctgttccagaagcccccaagggtggggaggcggaggacctggtgggcaagccttactctcaggatgcgtctcggagcccacagagcctcagtgacacaggctattcctctgacggcatctctagctcccagagtgagatcacaggagtcgtgcagcaggaggtggaacagctggacagtgcaggggtgacagggccacatccacccagcccctccgagatccacaaggtggggagcagcatgcggcctttgctgcaggcccagggcctggccccaagtgagcggagcaagccactctccagcggtactggcgaggagcagaagcagcggccccactccttgtccatcacgcctgaggcctttgactctgatgaggagctggaggatatcctggaggaagacgaagactctgctgagtggaggcgccggagagagcagcaggacactgccgagtcctcagacgactttggcagccaattgaggcacgactatgtggaggacagcagtgagggtggcctgtcccctcttccaccccagcccccagcccgggcagcagaactgactgatgaggatttcatgcgacggcagattctcgagatgagcgccgaggaagacaacctggaggaggatgacactgccacctccgggcgtggcctggccaaacatggcacccagaaaggtggccccagacccaggcctgagcctagccaagaaccagcagcactgcccaagaggcgcctgccccacaatgccaccacgggctatgaggagctgctccctgagggaggctcagcagaggctaccgatggcagtgggaccctgcagggtgggctccgtcgcttcaagaccattgagctcaacagcacgggaagttatggtcatgagttggacctgggccaaggcccagaccccagtctggaccgggagcctgagctggagatggagagcctaacgggctcccctgaggaccgctcccgtggtgagcactcctctacattgcctgcctccacacccagctacacctcgggcacctctcccacctctctgtcctccctagaggaggacagtgacagcagccccagccgcaggcagcgtctagaagaagcaaagcagcagcgcaaggcccggcaccgctcccacgggcccctgctacccaccatcgaggactcctcagaggaggaggagctgcgggaggaagaggagctgcttcgtgagcaagagaagatgcgggaggtggagcagcagcgcatccgcagcacagcccgcaagacccggcgggacaaggaagaactgcgggcccagcggaggcgagagcgctccaagacaccacccagtaacttgtcacccatcgaggatgcctccccgacggaggagctgaggcaggcggccgagatggaggagctacaccgctcctcctgctctgagtactcaccctcaccctcccttgactctgaggctgaggccttggatggtggccctagccggctttacaagtcaggcagtgagtacaacctgcccaccttcatgtccctctactcaccaaccgagacaccctccggcagctccaccactcccagttccggacggccgctcaagagcgctgaggaggcttatgaggagatgatgcgcaaagctgagctgctccagaggcagcaaggccaggcagcaggggcccggggaccccatggcggcccctctcagcccacaggcccccggggcctgggctccttcgaatatcaagacactacagaccgtgagtatggccaggctgctcagcctgccgcagagggcacgccagccagcctgggagcagccgtgtacgaagaaatccttcagacatcacagagcatagtccgcatgcggcaggcctcctcacgagacctggcttttgctgaggacaaaaagaaggagaagcagtttctaaatgctgagagtgcatacatggacccaatgaagcaaaatggtggcccccttacccctggtaccagtcccacccagctcgctgcccctgtgtccttctctacccccacctcctcagacagcagcgggggccgagttattcccgatgtccgtgtcactcagcattttgcaaaggagactcaggaccccctcaagctgcacagctctcctgcctcccccagctcagcctccaaggagataggcatgcccttttcccagggccctgggaccccagccaccacagctgtggctccttgtccagctgggctgccacgaggatatatgactccagcctccccagcaggctccgagcgtagtccttcaccatcttccacagcccacagctatggacacagcccaaccactgcaaactatgggtcccaaactgaggatctaccccaggcccccagtggccttgctgcagctggacgagctgctagagagaagcccttgagtgcgagtgacggtgagggtggcactcctcagccttcccgggcatattcctactttgcaagctccagcccacctctctccccgtcttccccctcagagagtcccacattctcccctggcaagatgggcccaagggccacagcagagttctctacacagacgccaagtccagcccctgcctcagacatgccacggagccctggtgcccccactccatcacctatggtagcccagggtacacaaacaccacatcgacccagcacgcctcgcctggtgtggcaggagtcctctcaagaggctccctttatggtcatcacgctggcatctgacgcctccagccagaccaggatggtacatgccagtgcctccacctccccgctctgctcacctactgaaacccagcccaccacccatggctacagccagacaacacctccgagtgtgtctcagctgcccccagagccacctgggccacctggctttccacgggtgcccagtgctggtgcagatgggcccctggcactatatggctggggtgccctccctgctgagaacatctccctgtgccggatctcctctgtccctgggacgtctagggttgagccaggccccaggacccctggcactgcagtggtagacctccgtacagctgtcaagcccactcccatcatcctcactgaccagggcatggacctcacctctcttgctgtggaagcgaggaagtatggtcttgccctggatccaatcccaggacggcagtcgaccgccgtgcagcccttggttatcaacctcaatgcccaggagcataccttccttgctactgccaccaccgtgagcatcaccatggcctcgtctgtgttcatggctcaacaaaagcagcctgtggtctatggagacccctaccagagccgccttgactttggccagggtgggggtagccctgtgtgcctggcccaggtcaaacaagtagagcaggctgtccagacagccccataccgaagtgggccccggggaagacccagggaggccaagtttgccagatataacctacccaaccaagtagctcctctggccagaagagacgttttgatcactcagatgggcaccgcccagagcattggcctcaagccaggcccagtgccagagccaggtgccgagccccaccgggccacccctgcagagctgcggtcacatgctctgccaggtgccaggaagccacacacagtggtggtgcagatgggagagggcacagcaggcactgtgaccacactgctcccagaggagcctgcgggtgccctggaccttaccgggatgaggcctgagagccagctggcatgctgtgacatggtctacaagctcccctttggcagcagctgcactggcaccttccacccggcccccagtgtgcctgagaagagcatggcagatgctgccccacctggccaaagcagcagccccttctatggtccccgggaccctgagcctcctgagcccccaacctaccgggcacagggggtggtggggcctgggccccatgaggagcagaggccctacccacaaggcctgcctggtaggctgtactcctccatgtctgacaccaatttggctgaggctggcctcaactaccatgcccagaggatcgggcagctcttccagggtcctggacgagactcggctatggacctcagctcactgaagcactcctacagcctgggctttgcggatggacgctacctagggcagggcttgcagtatggctcagtcacggacctgcgtcatcctacagaccttttggctcacccgcttcccatgcggcgctatagctcagtgtcgaacatctactcagaccacaggtacggcccacggggagatgcagttggcttccaggaggccagcctggcccagtacagtgccaccacagcccgtgaaatcagtcgcatgtgcgctgccctcaactccatggaccagtatggtgggcggcatggcagtggtggtggtggccctgaccttgtgcagtaccagccccagcacgggcccgggctcagtgctccacagagtctggttcccctcagacctggactccttggtaaccccacctttccagagggccacccaagtcctgggaacttggcccagtatgggcctgcagcaggccaaggaacagcagtcagacagctgctgccgtccacagccactgtacgtgcagctgatggcatgatctactcgactatcaataccccaattgctgcaacactgcccatcaccacccagcctgcctcagtcctgcggcccatggtgcgtggtggcatgtacaggccttacgcatctggtggaatcacagccgtgccactcaccagtctgacacgtgtgcccatgattgccccccgggtacctcttggacccacagggctgtaccgctatcctgcaccaagtagatttcccattgcttccagtgttccacctgcagaagggcctgtctatctggggaaacctgctgctgccaaggcccctggggctgggggcccttcaaggccagagatgccagtaggggctgcacgggaagagcctcttcccacaaccacccctgctgccatcaaggaggctgcaggagccccagctcctgccccactagctggccagaagccaccagcagatgctgctcctgggggtggcagtggggccctcagccggccagggttcgagaaagaggaagcatcacaggaggagaggcagcggaagcaacaggagcagctgctccagctagagcgggagcgggtggagttggagaagctgcgacaacttcggctgcaagaggagctagagcgggaacgtgtggagctgcagaggcaccgtgaggaggagcagctgctggtgcagcgggagttgcaggagctgcagaccatcaagcaccatgtgctgcagcagcagcaagaggaacgccaggctcaatttgcactgcagcgggaacagctagcgcagcagcgtctgcagctggagcagatccagcagctgcagcagcagctgcagcagcagctagaggagcagaagcagcggcagaaggctccctttcctgcagcctgtgaggcacctggccgagggcctcccctagcggctgctgagttggcccagaatggccagtattggcccccccttacacatgcagccttcattgccatggcagggcctgaaggacttgggcagcctcgtgagcctgtgctgcaccggggtctccccagctctgcctcagacatgtcactgcaaacggaggagcagtgggaggccagccgtagtggcatcaagaagcggcactccatgccacgcctgcgggatgcctgtgagctagagtctgggactgagccctgtgtggtcaggaggattgccgacagcagcgtgcagacagacgatgaggatggggagagccgctacctcttgagtcggcgacgccgggcacggcggagtgctgactgcagtgtgcagacggacgacgaagacagtgctgagtgggagcagccagtgcgccgccgcaggtctcgtcttccccgccactcagactcaggctctgacagcaagcacgatgccactgcctcatcatccagtgctgctgccactgtgagggccatgagcagcgtgggcatccagaccatcagtgactgctccgtgcagacggagcctgaccagctgcccagggtctctccagccatccacatcacagctgccaccgatcccaaggtggagatcgtcaggtacatatcggcgccagagaagactgggcgtggggagagcctggcctgccagacggagccagatgggcaggcccagggtgtagccgggccgcagcttgtagggccaactgccatcagcccctacctgcctggcatccagatcgtcaccccagggcctctgggcagatttgaaaaaaagaagccagatcccctggagattgggtaccaggcccacctgcctccggagtctctctcacagcttgtgagccgccagcctcccaagtcccctcaggtcctctactcaccagtctcacccctgtcccctcaccggctcctggacacctcctttgcttccagtgagaggctgaacaaagctcacgtgagtccccagaagcacttcacggctgacagcgctctccgccagcagacgctgcctcgccccatgaagaccctgcagcggtccctgtctgaccctaagcccctcagccccaccgccgaagagtctgccaaagagagattctccctctaccagcaccaggggggactgggtagccaggtgtcggcgttgccacccaacagcctggtccgcaaggtgaagcggacactgcccagcccccctccagaggaggctcaccttcccctggctggccaggcctccccacagctgtatgcagccagcctgctgcagcgagggctgacggggcccaccactgtccctgctaccaaggccagcctgctccgggagctggaccgggacctgcggctggtggagcatgagtccaccaaactgcgcaagaagcaggcagagctggatgaggaggagaaggagattgacgccaagctcaagtacctggagttgggtatcacacaacgcaaagagtctttggccaaagaccggggtggccgtgactacccacccttgcgtggtcttggcgagcatcgtgactacctatcggacagtgagctcaaccagctgcggctccagggctgcaccactcccgctggccagtttgtggacttccctgccactgccgctgctcctgccaccccctctggtcccactgccttccagcagccccgcttccagcctccagccccacagtattctgcaggcagtggtgggccaactcagaacggattcccagcccaccaggcccccacctaccctggccccagcacgtacccagctcctgcctttcctcctggtgccagttacccagctgagcctggcctgccaaaccagcaggctttccgccccacaggccactatgcaggccaaacacccatgccaaccacacagagcaccctttttccagtccccgctgatagccgtgccccactgcagaagccacgccagacatcgctagccgacttggagcagaaggtgcccaccaactatgaggtgatcgccagccccgttgtgcccatgtcttcagccccatctgaaaccagctacagtggcccagcagtgagcagcggctatgagcagggcaaggtccctgaggtgccccgggctggtgaccgtggcagtgtgagccagagcccagcccccacctacccctctgactcacactataccagtctggagcagaacgttcctcgaaactacgtaatgattgatgacatcagtgaactgaccaaggacagcacctctactgctcctgatagccaacggctggagcccctggggccaggcagcagtgggcgtccagggaaggagcctggagaaccaggtgtccttgacgggcccacactgccctgctgctatgccagaggagaagaggaatctgaggaggactcatacgatccccgcgggaagggtggccacctccggagcatggagagcaatggtcgaccagccagtacccactactatggtgacagtgactacaggcatggggctcgagtagagaagtatggtccagggcccatggggcccaagcatccctccaagagcctggctccagctgccatctcctcaaagcgcagcaagcaccggaagcagggcatggagcaaaagatatccaagttctcgcctattgaagaggccaaagacgtagagtcagacctggcgtcctaccccccacctgcagtcagcagcagcctggtctctcggggcaggaagttccaggatgaaatcacctatgggctcaagaagaacgtgtatgagcagcaaaaatactatgggatgtccagccgggacgcagtggaggacgaccgcatttatggcgggagcagccggtcccgggcaccttctgcatacagtggggagaagctgtccagccacgacttcagtggctggggcaaggggtacgaaagggaacgggaggctgtggagcgacttcaaaaagcgggccccaagccctcatccctaagtatggcccacagccgggtacgaccccccatgcggagccaggcctctgaagaggagagccccgtcagtcctttggggaggccccgccctgccggagggcccctccctcccggcggggatacctgcccacagttctgctccagccactccatgcctgatgtccaggaacatgtcaaggacggacctcgggcccacgcatataagcgtgaggagggctacatcctggatgattcccattgcgtggtttccgacagcgaaggtaatggcagccaggggtgatttctgcggatactcagcagctggggggcctgcctacctgtggggccctgggccctaagatgtcccagcagggtctggtctggcgcctcatctggtgggccctgctgcaggcaggctgcccttgcctgctccatctgtgccctggtccgtggttgcgggagggtgggctgggggcctgctgatctgcttgtggctgtggcacccactctcttggtttctttgcatggcttcagctaggcctccccctgcggctagcccgggggttgatggtattctgtttttggtctctgaagcgtatcacctgggccaggaggagacggactggtttgataagccccgggatgcccgctctgaccggttcaggcaccacgggggccatgcagtttcctcctcctcccagaagcgaggccctgccaggcacagctaccatgactacgatgaaccccctgaggagggcctgtggcctcatgatgagggtggcccaggccgccatgcctcagccaaggaacaccggcacggtgaccacgggcggcactcaggccgccacactggtgaggagccgggacggcgtgctgccaaaccacacgctcgggacctgggtcgccatgaggcccggccccactctcagcccagctctgctccagctatgccgaagaagggtcagcctgggtatcccagctctgctgagtactcacagccatcccgtgcttcatccgcataccatcatgcctctgacagcaagaagggctcccggcaagcccactccgggcccgctgcactgcagtcaaaggcagaaccccaggcgcagccgcagctgcaaggtcggcaggcagctccaggaccacagcagtcacagtcaccatcatccaggcaaataccctctggggcagcatcacgccagccacagacacagcagcagcagcaaggtcttgggctgcagcccccacagcaggctctgacacaggctcggctgcagcaacagagccagccaaccacccggggctcagcccctgctgccagccagcctgcagggaagcctcagccaggccccagcacagccacaggtcctcaaccagcaggaccgccacgggcagaacagacaaatggctctaaagggacagccaaagcaccgcaacaggggagggctcctcaggcccagccaacaccaggacctggacctgcaggtgtgaaggctggagccaggcctggaggaaccccaggggctcccgccggccagccaggtgccgatggggagagcgtgttctccaagatcctccctggcggggcagccgagcaagctggcaaactgacggaagctgtctctgcttttggcaaaaaattttcctcattctggtgaccatgcccagcatggctcttgaagaaatgaagagaggtatcattgctgtggaaaaatctctggagtcagaggcctgggcgcagctctggactctgcgtataacacatctacaatctggcaaacccttggcccaaagactcaccaggtgggacgtggcaggcaggcctcagttgaggacgtgatgttttctcacagcagctgcctgggtgaagcatctgctggacaagtcggaccactggccaggggacctttgattgtctttccagagatgctgctctctgcagggcaccaccttcaaggcacagcccttgttgggagggagaaccctctccagaaaccctgccaccatggtgtcttgccgtacttcccacagccgcctttttgcggcctggccggccaggcttcccgtgcgttatacacagagtttgggcacacactgccctccctccgagatgccagaagtttttccacagccttggagaggggctttgactgagggctgggggccctgggctccgtttccttcacattccagctggcccggatccctctgtggcacagggccctgcccgtcacatgccctctgggtgacatcggagcagacctccatgtggccaggggttgggagaactttacaaacattaggacctaacactgtctcatcgctgaaataagaggccatagcaccgaaaagcagcgtgggcgccggctgaggcttctcccagcccgtgggtggcagcgtgctagcacactgccaccatctcaaagccatccccctagccatcgtgagcatcccagcggcaccgccattgtctcaaccagccggctcctcgtctgtacacctggggatttcttttgatttcaagaacagccttaatcattccagtttgatttacgtgtatacctcataaacatttttcttttgtttctctctccccctttctctcttctcttggctcactcccttgcctctccccctccaccaccaccttgtgactgatggtttggtttcctctctgctctgcccctgctcagcacagggagaatgttgacttagaagcaatagggggcagcaggccaccaagagcacaaccccagggcgaggtctggggaggcctcccagcccgcctctgtttactgtgcaattccagtcgttcttaagccatcaccagtgggtgtactcagagcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggatagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggaggctcaaaggactgtgagccgggagatctgggctggagctagggggtcaatggatgctcaggaagagctgggcctttggcacttgtggtgagaacagttgacagtggtcatctggaactgttcatataaacagtggcttcaagctaagtttcttgtgaagtttctcaatagcaaatcttacagaaggtcctgtgtgaccctctctgcatctgtccccaggacctatgctccctgctcacccccttctccaaagcccaagcgtcccgctgctcatcagcttttttaccattgagccaggagtgcggcaggcagtacctgcctgacccttcaaggcctgaccttcgtccagagtgctctggtttgcaccatgcatttctcaggggtccgcatttctcatgcttttctataagatctacacaccccttcagagagggctcctcgctcacctctggtagctatggatgggacaggaagctgccaacctttgtgttggacttaacacccttgcctttctgggacttggcctcaccccacccatggaatacctgcctcatcccaaagatcaggtatgggctgaatgcagccatctgagcaagggctgagggaagccatcatctaacacctctggccacccaggaccaggtctgtgtggggatgtgccttggagaccaaggcaatagtcctttccactacaggccaggggatgggacaagaagtagggaacaggcagggaaatgttaggaggtcagcctccagcaggcctagtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttctccatacccctctccccagcatcatgagcaagggcattgcctcctctctctgctcacttcagggcccagtgcactcacttcacagtgacagccctcccctacaatccttgggcagagcatgtggtctgagggcccacagtgaaagaacagcagtggtggcaactatgccttgccttctggagcctgtagggagttttccaggcaggtcctttgccaggacagcatggtcctgccctgttgtcccgtctgctctcctcttacccacccccatgctgtaaatacttgtcatcatggactccaacagggttagagggacaggcctaatcaactgaaactcctcggagatgccatctctgtctccctgggtgccagcagccctgctgccatgtgcactggggtggcactggagagccatggcagtcgtgagatattgtatgtgtatgcacatgatcatgtgtgtatgtgcgtgcgtgcgtgtgtgtgtgtgtgtgtgtgtttctgcctcattcagtttctggggtcaaatcagctccttctctccaagtgcactaccctggagagtggtggccactcaataccttttcctctagctttcatgtcttgtttttgctttccccttcctcctccctctctccctttctttccttctctccttctttatttgaggggggaagagtgctgtacaaagtcaaacaaacaagtttacagttgtaagtgcaatgacccgagtcctccacatgaccttgtgaattgtgtgctgtccttctgtgctctgtgagaactcgtggtacttcagtgtccctccccctgtattgtgacaaggtaattctgtggtatcagaataaaaggacttgatataaacaacctaaagac

SEQ ID NO: 449809 - DNA, 2975 bp, Homo sapiens
  misc_feature (70)..(70): n is a, c, g, or t
cagtttctcaattgcatgtttgcaattaactccttatacataacatggaatttattaaatattaacagtngtcattgagggtttatatttcattgcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggatagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggaggctcaaaggactgtgagccgggagatctgggctggagctagggggtcaatggatgctcaggaagagctgggcctttggcacttgtggtgagaacagttgacagtggtcatctggaactgttcatataaacagtggcttcaagctaagtttcttgtgaagtttctcaatagcaaatcttacagaaggtcctgtgtgaccctctctgcatctgtccccaggacctatgctccctgctcacccccttctccaaagcccaagcgtcccgctgctcatcagcttttttaccattgagccaggagtgcggcaggcagtacctgcctgacccttcaaggcctgaccttcgtccagagtgctctggtttgcaccatgcatttctcaggggtccgcatttctcatgcttttctataagatctacacaccccttcagagagggctcctcgctcacctctggtagctatggatgggacaggaagctgccaacctttgtgttggacttaacacccttgcctttctgggacttggcctcaccccacccatggaatacctgcctcatcccaaagatcaggtatgggctgaatgcagccatctgagcaagggctgagggaagccatcatctaacacctctggccacccaggaccaggtctgtgtggggatgtgccttggagaccaaggcaatagtcctttccactacaggccaggggatgggacaagaagtagggaacaggcagggaaatgttaggaggtcagcctccagcaggcctagtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttctccatacccctctccccagcatcatgagcaagggcattgcctcctctctctgctcacttcagggcccagtgcactcacttcacagtgacagccctcccctacaatccttgggcagagcatgtggtctgagggcccacagtgaaagaacagcagtggtggcaactatgccttgccttctggagcctgtagggagttttccaggcaggtcctttgccaggacagcatggtcctgccctgttgtcccgtctgctctcctcttacccacccccatgctgtaaatacttgtcatcatggactccaacagggttagagggacaggcctaatcaactgaaactcctcggagatgccatctctgtctccctgggtgccagcagccctgctgccatgtgcactggggtggcactggagagccatggcagtcgtgagatattgtatgtgtatgcacatgatcatgtgtgtatgtgcgtgcgtgcgtgtgtgtgtgtgtgtgtgtgtttctgcctcattcagtttctggggtcaaatcagctccttctctccaagtgcactaccctggagagtggtggccactcaataccttttcctctagctttcatgtcttgtttttgctttccccttcctcctccctctctccctttctttccttctctccttctttatttgaggggggaagagtgctgtacaaagtcaaacaaacaagtttacagttgtaagtgcaatgacccgagtcctccacatgaccttgtgaattgtgtgctgtccttctgtgctctgtgagaactcgtggtacttcagtgtccctccccctgtattgtgacaaggtaattctgtggtatcagaataaaaggacttgatataaacaacctaaagac

SEQ ID NO: 449810 - DNA, 484 bp, Homo sapiens
cctctagagagttgtgtcacgcttgtagagattgtgcacgcgcgcgtgtgtgtgtgtgtgtgtgtgtgtgtatgtgcgtgcgtgcgtgtgtgtgtgtgtgtgtgtgtttctgcctcattcagtttctggggtcaaatcagctccttctctccaagtgcactaccctggagagtggtggccactcaataccttttcctctagctttcatgtcttgtttttgctttccccttcctcctccctctctccctttctttccttctctccttctttatttgaggggggaagagtgctgtacaaagtcaaacaaacaagtttacagttgtaagtgcaatgacccgagtcctccacatgaccttgtgaattgtgtgctgtccttctgtgctctgtgagaactcgtggtacttcagtgtccctccccctgtattgtgacaaggtaattctgtggtatcagaataaaaggacttgatataaacaacctaaagac

SEQ ID NO: 449811 - DNA, 325 bp, Homo sapiens
aaatattatttgaggacttcagtgtctttttaattttcatcaaccccctctcccatttccttgcagaaaacagagtggctctgtctgaactgccaaaccaagcggctactggagggcagcctaggagagccgacccccctgccgccgcccacctcacagcagccccctgtaggggcccctcaccgtgcatctggaacatcccctctgaagcagaaagggccacaggggctgggccagccttcaggccccctgcctgccaaggccagccctctatccaccaaggccagccctctgcccagcaaggccagcccccaggccaagcccc

SEQ ID NO: 449812 - DNA, 15963 bp, Homo sapiens
agagccgagctgggagatggcggcggcagcggcggcgccgagagtgtgagcaccgcccgggagccgccggcccgggcgcagcgcgaccccgaccccgcccgcccgcctgcccgccatgggcaacgaggtcagcctggagggcggcgctggcgacgggccgctgccgcccggcggcgccggccccggcccgggccccggccccggccccggcgcaggaaagccgccttcagcaccggccggtggcggacagctccccgcggcgggagcagcgcggtcgaccgcggtaccaccggtccctggccccggccccggccccggtcccggccctggcccgggcagcacttcccggagactggaccccaaggaacccctgggtaaccagagagcagcttccccaactccgaagcaggcttctgctaccactcctggccatgagagcccccgagagacaagggcacagggaccagcaggccaggaggctgatggtccccgcaggacgctgcaggtagacagcaggacacagagatcagggcggtccccctcagtgtcaccggacagaggcagcacccccacatcaccctactccgtccctcagatcgccccccttcccagcagcacgctgtgtcccatatgcaagacttcggacctcacgtcgacccccagccagccaaacttcaacacctgcacccagtgtcacaacaaggtctgcaaccagtgtgggttcaaccccaaccctcatctcacccaggtgaaggagtggctctgtctgaactgtcagatgcagagggctctgggaatggacatgaccactgcacctcgctccaagagccagcagcagctgcactccccagccctgtctcctgcccactccccggccaaacagcccctggggaagccagaccaagagagatctcggggcccaggaggaccacagcctgggtcccgccaggctgagacagccagggccacctcagtgccggggcctgcccaagcagctgcccctccagaggtggggagggtgtctcctcagccccctcaacccaccaagccttccacagctgagcccaggccacctgcaggagaggccccggccaaaagtgccaccgcagtgcccgctgggcttggtgccactgagcagacccaggagggcctcactggtaagctcttcggccttggcgcgtcactgctaacccaggcgagcaccctcatgtctgtgcagcccgaggctgacacccagggccagcctgcccccagcaaggggacacctaagatcgtcttcaatgatgccagcaaggaggctggcccaaaacccttgggctcagggcccgggcctgggccagcacctggagccaaaactgagcctggggctagaatgggtcctggatctggacctggagccctgccgaaaactgggggaacaaccagtccaaagcatggcagagcagaacatcaggcagcatcgaaggctgctgccaagccaaagaccatgccgaaggaaagggccatctgcccactgtgccaagccgagctcaacgtgggcagcaagagcccagccaactataacacatgcaccacctgcaggctccaggtgtgcaacctgtgtggcttcaacccaacaccccacctggtggagaaaacagagtggctctgtctgaactgccaaaccaagcggctactggagggcagcctaggagagccgacccccctgccgccgcccacctcacagcagccccctgtaggggcccctcaccgtgcatctggaacatcccctctgaagcagaaagggccacaggggctgggccagccttcaggccccctgcctgccaaggccagccctctatccaccaaggccagccctctgcccagcaaggccagcccccaggccaagcccctcagggcttctgaacccagcaagaccccaagcagtgtccaggaaaagaagacccgagtccccactaaagctgagcccatgccgaagccacctccagagactaccccaacccctgcgactcctaaagtaaagagtggggtgaggagggctgaacctgccacccctgtcgtcaaggctgttccagaagcccccaagggtggggaggcggaggacctggtgggcaagccttactctcaggatgcgtctcggagcccacagagcctcagtgacacaggctattcctctgacggcatctctagctcccagagtgagatcacaggagtcgtgcagcaggaggtggaacagctggacagtgcaggggtgacagggccacatccacccagcccctccgagatccacaaggtggggagcagcatgcggcctttgctgcaggcccagggcctggccccaagtgagcggagcaagccactctccagcggtactggcgaggagcagaagcagcggccccactccttgtccatcacgcctgaggcctttgactctgatgaggagctggaggatatcctggaggaagacgaagactctgctgagtggaggcgccggagagagcagcaggacactgccgagtcctcagacgactttggcagccaattgaggcacgactatgtggaggacagcagtgagggtggcctgtcccctcttccaccccagcccccagcccgggcagcagaactgactgatgaggatttcatgcgacggcagattctcgagatgagcgccgaggaagacaacctggaggaggatgacactgccacctccgggcgtggcctggccaaacatggcacccagaaaggtggccccagacccaggcctgagcctagccaagaaccagcagcactgcccaagaggcgcctgccccacaatgccaccacgggctatgaggagctgctccctgagggaggctcagcagaggctaccgatggcagtgggaccctgcagggtgggctccgtcgcttcaagaccattgagctcaacagcacgggaagttatggtcatgagttggacctgggccaaggcccagaccccagtctggaccgggagcctgagctggagatggagagcctaacgggctcccctgaggaccgctcccgtggtgagcactcctctacattgcctgcctccacacccagctacacctcgggcacctctcccacctctctgtcctccctagaggaggacagtgacagcagccccagccgcaggcagcgtctagaagaagcaaagcagcagcgcaaggcccggcaccgctcccacgggcccctgctacccaccatcgaggactcctcagaggaggaggagctgcgggaggaagaggagctgcttcgtgagcaagagaagatgcgggaggtggagcagcagcgcatccgcagcacagcccgcaagacccggcgggacaaggaagaactgcgggcccagcggaggcgagagcgctccaagacaccacccagtaacttgtcacccatcgaggatgcctccccgacggaggagctgaggcaggcggccgagatggaggagctacaccgctcctcctgctctgagtactcaccctcaccctcccttgactctgaggctgaggccttggatggtggccctagccggctttacaagtcaggcagtgagtacaacctgcccaccttcatgtccctctactcaccaaccgagacaccctccggcagctccaccactcccagttccggacggccgctcaagagcgctgaggaggcttatgaggagatgatgcgcaaagctgagctgctccagaggcagcaaggccaggcagcaggggcccggggaccccatggcggcccctctcagcccacaggcccccggggcctgggctccttcgaatatcaagacactacagaccgtgagtatggccaggctgctcagcctgccgcagagggcacgccagccagcctgggagcagccgtgtacgaagaaatccttcagacatcacagagcatagtccgcatgcggcaggcctcctcacgagacctggcttttgctgaggacaaaaagaaggagaagcagtttctaaatgctgagagtgcatacatggacccaatgaagcaaaatggtggcccccttacccctggtaccagtcccacccagctcgctgcccctgtgtccttctctacccccacctcctcagacagcagcgggggccgagttattcccgatgtccgtgtcactcagcattttgcaaaggagactcaggaccccctcaagctgcacagctctcctgcctcccccagctcagcctccaaggagataggcatgcccttttcccagggccctgggaccccagccaccacagctgtggctccttgtccagctgggctgccacgaggatatatgactccagcctccccagcaggctccgagcgtagtccttcaccatcttccacagcccacagctatggacacagcccaaccactgcaaactatgggtcccaaactgaggatctaccccaggcccccagtggccttgctgcagctggacgagctgctagagagaagcccttgagtgcgagtgacggtgagggtggcactcctcagccttcccgggcatattcctactttgcaagctccagcccacctctctccccgtcttccccctcagagagtcccacattctcccctggcaagatgggcccaagggccacagcagagttctctacacagacgccaagtccagcccctgcctcagacatgccacggagccctggtgcccccactccatcacctatggtagcccagggtacacaaacaccacatcgacccagcacgcctcgcctggtgtggcaggagtcctctcaagaggctccctttatggtcatcacgctggcatctgacgcctccagccagaccaggatggtacatgccagtgcctccacctccccgctctgctcacctactgaaacccagcccaccacccatggctacagccagacaacacctccgagtgtgtctcagctgcccccagagccacctgggccacctggctttccacgggtgcccagtgctggtgcagatgggcccctggcactatatggctggggtgccctccctgctgagaacatctccctgtgccggatctcctctgtccctgggacgtctagggttgagccaggccccaggacccctggcactgcagtggtagacctccgtacagctgtcaagcccactcccatcatcctcactgaccagggcatggacctcacctctcttgctgtggaagcgaggaagtatggtcttgccctggatccaatcccaggacggcagtcgaccgccgtgcagcccttggttatcaacctcaatgcccaggagcataccttccttgctactgccaccaccgtgagcatcaccatggcctcgtctgtgttcatggctcaacaaaagcagcctgtggtctatggagacccctaccagagccgccttgactttggccagggtgggggtagccctgtgtgcctggcccaggtcaaacaagtagagcaggctgtccagacagccccataccgaagtgggccccggggaagacccagggaggccaagtttgccagatataacctacccaaccaagtagctcctctggccagaagagacgttttgatcactcagatgggcaccgcccagagcattggcctcaagccaggcccagtgccagagccaggtgccgagccccaccgggccacccctgcagagctgcggtcacatgctctgccaggtgccaggaagccacacacagtggtggtgcagatgggagagggcacagcaggcactgtgaccacactgctcccagaggagcctgcgggtgccctggaccttaccgggatgaggcctgagagccagctggcatgctgtgacatggtctacaagctcccctttggcagcagctgcactggcaccttccacccggcccccagtgtgcctgagaagagcatggcagatgctgccccacctggccaaagcagcagccccttctatggtccccgggaccctgagcctcctgagcccccaacctaccgggcacagggggtggtggggcctgggccccatgaggagcagaggccctacccacaaggcctgcctggtaggctgtactcctccatgtctgacaccaatttggctgaggctggcctcaactaccatgcccagaggatcgggcagctcttccagggtcctggacgagactcggctatggacctcagctcactgaagcactcctacagcctgggctttgcggatggacgctacctagggcagggcttgcagtatggctcagtcacggacctgcgtcatcctacagaccttttggctcacccgcttcccatgcggcgctatagctcagtgtcgaacatctactcagaccacaggtacggcccacggggagatgcagttggcttccaggaggccagcctggcccagtacagtgccaccacagcccgtgaaatcagtcgcatgtgcgctgccctcaactccatggaccagtatggtgggcggcatggcagtggtggtggtggccctgaccttgtgcagtaccagccccagcacgggcccgggctcagtgctccacagagtctggttcccctcagacctggactccttggtaaccccacctttccagagggccacccaagtcctgggaacttggcccagtatgggcctgcagcaggccaaggaacagcagtcagacagctgctgccgtccacagccactgtacgtgcagctgatggcatgatctactcgactatcaataccccaattgctgcaacactgcccatcaccacccagcctgcctcagtcctgcggcccatggtgcgtggtggcatgtacaggccttacgcatctggtggaatcacagccgtgccactcaccagtctgacacgtgtgcccatgattgccccccgggtacctcttggacccacagggctgtaccgctatcctgcaccaagtagatttcccattgcttccagtgttccacctgcagaagggcctgtctatctggggaaacctgctgctgccaaggcccctggggctgggggcccttcaaggccagagatgccagtaggggctgcacgggaagagcctcttcccacaaccacccctgctgccatcaaggaggctgcaggagccccagctcctgccccactagctggccagaagccaccagcagatgctgctcctgggggtggcagtggggccctcagccggccagggttcgagaaagaggaagcatcacaggaggagaggcagcggaagcaacaggagcagctgctccagctagagcgggagcgggtggagttggagaagctgcgacaacttcggctgcaagaggagctagagcgggaacgtgtggagctgcagaggcaccgtgaggaggagcagctgctggtgcagcgggagttgcaggagctgcagaccatcaagcaccatgtgctgcagcagcagcaagaggaacgccaggctcaatttgcactgcagcgggaacagctagcgcagcagcgtctgcagctggagcagatccagcagctgcagcagcagctgcagcagcagctagaggagcagaagcagcggcagaaggctccctttcctgcagcctgtgaggcacctggccgagggcctcccctagcggctgctgagttggcccagaatggccagtattggcccccccttacacatgcagccttcattgccatggcagggcctgaaggacttgggcagcctcgtgagcctgtgctgcaccggggtctccccagctctgcctcagacatgtcactgcaaacggaggagcagtgggaggccagccgtagtggcatcaagaagcggcactccatgccacgcctgcgggatgcctgtgagctagagtctgggactgagccctgtgtggtcaggaggattgccgacagcagcgtgcagacagacgatgaggatggggagagccgctacctcttgagtcggcgacgccgggcacggcggagtgctgactgcagtgtgcagacggacgacgaagacagtgctgagtgggagcagccagtgcgccgccgcaggtctcgtcttccccgccactcagactcaggctctgacagcaagcacgatgccactgcctcatcatccagtgctgctgccactgtgagggccatgagcagcgtgggcatccagaccatcagtgactgctccgtgcagacggagcctgaccagctgcccagggtctctccagccatccacatcacagctgccaccgatcccaaggtggagatcgtcaggtacatatcggcgccagagaagactgggcgtggggagagcctggcctgccagacggagccagatgggcaggcccagggtgtagccgggccgcagcttgtagggccaactgccatcagcccctacctgcctggcatccagatcgtcaccccagggcctctgggcagatttgaaaaaaagaagccagatcccctggagattgggtaccaggcccacctgcctccggagtctctctcacagcttgtgagccgccagcctcccaagtcccctcaggtcctctactcaccagtctcacccctgtcccctcaccggctcctggacacctcctttgcttccagtgagaggctgaacaaagctcacgtgagtccccagaagcacttcacggctgacagcgctctccgccagcagacgctgcctcgccccatgaagaccctgcagcggtccctgtctgaccctaagcccctcagccccaccgccgaagagtctgccaaagagagattctccctctaccagcaccaggggggactgggtagccaggtgtcggcgttgccacccaacagcctggtccgcaaggtgaagcggacactgcccagcccccctccagaggaggctcaccttcccctggctggccaggcctccccacagctgtatgcagccagcctgctgcagcgagggctgacggggcccaccactgtccctgctaccaaggccagcctgctccgggagctggaccgggacctgcggctggtggagcatgagtccaccaaactgcgcaagaagcaggcagagctggatgaggaggagaaggagattgacgccaagctcaagtacctggagttgggtatcacacaacgcaaagagtctttggccaaagaccggggtggccgtgactacccacccttgcgtggtcttggcgagcatcgtgactacctatcggacagtgagctcaaccagctgcggctccagggctgcaccactcccgctggccagtttgtggacttccctgccactgccgctgctcctgccaccccctctggtcccactgccttccagcagccccgcttccagcctccagccccacagtattctgcaggcagtggtgggccaactcagaacggattcccagcccaccaggcccccacctaccctggccccagcacgtacccagctcctgcctttcctcctggtgccagttacccagctgagcctggcctgccaaaccagcaggctttccgccccacaggccactatgcaggccaaacacccatgccaaccacacagagcaccctttttccagtccccgctgatagccgtgccccactgcagaagccacgccagacatcgctagccgacttggagcagaaggtgcccaccaactatgaggtgatcgccagccccgttgtgcccatgtcttcagccccatctgaaaccagctacagtggcccagcagtgagcagcggctatgagcagggcaaggtccctgaggtgccccgggctggtgaccgtggcagtgtgagccagagcccagcccccacctacccctctgactcacactataccagtctggagcagaacgttcctcgaaactacgtaatgattgatgacatcagtgaactgaccaaggacagcacctctactgctcctgatagccaacggctggagcccctggggccaggcagcagtgggcgtccagggaaggagcctggagaaccaggtgtccttgacgggcccacactgccctgctgctatgccagaggagaagaggaatctgaggaggactcatacgatccccgcgggaagggtggccacctccggagcatggagagcaatggtcgaccagccagtacccactactatggtgacagtgactacaggcatggggctcgagtagagaagtatggtccagggcccatggggcccaagcatccctccaagagcctggctccagctgccatctcctcaaagcgcagcaagcaccggaagcagggcatggagcaaaagatatccaagttctcgcctattgaagaggccaaagacgtagagtcagacctggcgtcctaccccccacctgcagtcagcagcagcctggtctctcggggcaggaagttccaggatgaaatcacctatgggctcaagaagaacgtgtatgagcagcaaaaatactatgggatgtccagccgggacgcagtggaggacgaccgcatttatggcgggagcagccggtcccgggcaccttctgcatacagtggggagaagctgtccagccacgacttcagtggctggggcaaggggtacgaaagggaacgggaggctgtggagcgacttcaaaaagcgggccccaagccctcatccctaagtatggcccacagccgggtacgaccccccatgcggagccaggcctctgaagaggagagccccgtcagtcctttggggaggccccgccctgccggagggcccctccctcccggcggggatacctgcccacagttctgctccagccactccatgcctgatgtccaggaacatgtcaaggacggacctcgggcccacgcatataagcgtgaggagggctacatcctggatgattcccattgcgtggtttccgacagcgaagcgtatcacctgggccaggaggagacggactggtttgataagccccgggatgcccgctctgaccggttcaggcaccacgggggccatgcagtttcctcctcctcccagaagcgaggccctgccaggcacagctaccatgactacgatgaaccccctgaggagggcctgtggcctcatgatgagggtggcccaggccgccatgcctcagccaaggaacaccggcacggtgaccacgggcggcactcaggccgccacactggtgaggagccgggacggcgtgctgccaaaccacacgctcgggacctgggtcgccatgaggcccggccccactctcagcccagctctgctccagctatgccgaagaagggtcagcctgggtatcccagctctgctgagtactcacagccatcccgtgcttcatccgcataccatcatgcctctgacagcaagaagggctcccggcaagcccactccgggcccgctgcactgcagtcaaaggcagaaccccaggcgcagccgcagctgcaaggtcggcaggcagctccaggaccacagcagtcacagtcaccatcatccaggcaaataccctctggggcagcatcacgccagccacagacacagcagcagcagcaaggtcttgggctgcagcccccacagcaggctctgacacaggctcggctgcagcaacagagccagccaaccacccggggctcagcccctgctgccagccagcctgcagggaagcctcagccaggccccagcacagccacaggtcctcaaccagcaggaccgccacgggcagaacagacaaatggctctaaagggacagccaaagcaccgcaacaggggagggctcctcaggcccagccaacaccaggacctggacctgcaggtgtgaaggctggagccaggcctggaggaaccccaggggctcccgccggccagccaggtgccgatggggagagcgtgttctccaagatcctccctggcggggcagccgagcaagctggcaaactgacggaagctgtctctgcttttggcaaaaaattttcctcattctggtgaccatgcccagcatggctcttgaagaaatgaagagaggtatcattgctgtggaaaaatctctggagtcagaggcctgggcgcagctctggactctgcgtataacacatctacaatctggcaaacccttggcccaaagactcaccaggtgggacgtggcaggcaggcctcagttgaggacgtgatgttttctcacagcagctgcctgggtgaagcatctgctggacaagtcggaccactggccaggggacctttgattgtctttccagagatgctgctctctgcagggcaccaccttcaaggcacagcccttgttgggagggagaaccctctccagaaaccctgccaccatggtgtcttgccgtacttcccacagccgcctttttgcggcctggccggccaggcttcccgtgcgttatacacagagtttgggcacacactgccctccctccgagatgccagaagtttttccacagccttggagaggggctttgactgagggctgggggccctgggctccgtttccttcacattccagctggcccggatccctctgtggcacagggccctgcccgtcacatgccctctgggtgacatcggagcagacctccatgtggccaggggttgggagaactttacaaacattaggacctaacactgtctcatcgctgaaataagaggccatagcaccgaaaagcagcgtgggcgccggctgaggcttctcccagcccgtgggtggcagcgtgctagcacactgccaccatctcaaagccatccccctagccatcgtgagcatcccagcggcaccgccattgtctcaaccagccggctcctcgtctgtacacctggggatttcttttgatttcaagaacagccttaatcattccagtttgatttacgtgtatacctcataaacatttttcttttgtttctctctccccctttctctcttctcttggctcactcccttgcctctccccctccaccaccaccttgtgactgatggtttggtttcctctctgctctgcccctgctcagcacagggagaatgttgacttagaagcaatagggggcagcaggccaccaagagcacaaccccagggcgaggtctggggaggcctcccagcccgcctctgtttactgtgcaattccagtcgttcttaagccatcaccagtgggtgtactcagagcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggatagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggaggctcaaaggactgtgagccgggagatctgggctggagctagggggtcaatggatgctcaggaagagctgggcctttggcacttgtggtgagaacagttgacagtggtcatctggaactgttcatataaacagtggcttcaagctaagtttcttgtgaagtttctcaatagcaaatcttacagaaggtcctgtgtgaccctctctgcatctgtccccaggacctatgctccctgctcacccccttctccaaagcccaagcgtcccgctgctcatcagcttttttaccattgagccaggagtgcggcaggcagtacctgcctgacccttcaaggcctgaccttcgtccagagtgctctggtttgcaccatgcatttctcaggggtccgcatttctcatgcttttctataagatctacacaccccttcagagagggctcctcgctcacctctggtagctatggatgggacaggaagctgccaacctttgtgttggacttaacacccttgcctttctgggacttggcctcaccccacccatggaatacctgcctcatcccaaagatcaggtatgggctgaatgcagccatctgagcaagggctgagggaagccatcatctaacacctctggccacccaggaccaggtctgtgtggggatgtgccttggagaccaaggcaatagtcctttccactacaggccaggggatgggacaagaagtagggaacaggcagggaaatgttaggaggtcagcctccagcaggcctagtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttctccatacccctctccccagcatcatgagcaagggcattgcctcctctctctgctcacttcagggcccagtgcactcacttcacagtgacagccctcccctacaatccttgggcagagcatgtggtctgagggcccacagtgaaagaacagcagtggtggcaactatgccttgccttctggagcctgtagggagttttccaggcaggtcctttgccaggacagcatggtcctgccctgttgtcccgtctgctctcctcttacccacccccatgctgtaaatacttgtcatcatggactccaacagggttagagggacaggcctaatcaactgaaactcctcggagatgccatctctgtctccctgggtgccagcagccctgctgccatgtgcactggggtggcactggagagccatggcagtcgtgagatattgtatgtgtatgcacatgatcatgtgtgtatgtgcgtgcgtgcgtgtgtgtgtgtgtgtgtgtgtttctgcctcattcagtttctggggtcaaatcagctccttctctccaagtgcactaccctggagagtggtggccactcaataccttttcctctagctttcatgtcttgtttttgctttccccttcctcctccctctctccctttctttccttctctccttctttatttgaggggggaagagtgctgtacaaagtcaaacaaacaagtttacagttgtaagtgcaatgacccgagtcctccacatgaccttgtgaattgtgtgctgtccttctgtgctctgtgagaactcgtggtacttcagtgtccctccccctgtattgtgacaaggtaattctgtggtatcagaataaaaggacttgatataaacaacctaaagac

SEQ ID NO: 449813 - DNA, 13081 bp, Homo sapiens
ttctggtggtgatggggcttggcagggtcacctagcttggtagagacctccgcaagctgcttctctaagctgtatctctaacagtcattttcaatgtcatttcagcacttcccggagactggaccccaaggaacccctgggtaaccagagagcagcttccccaactccgaagcaggcttctgctaccactcctggccatgagagcccccgagagacaagggcacagggaccagcaggccaggaggctgatggtccccgcaggacgctgcaggtagacagcaggacacagagatcagggcggtccccctcagtgtcaccggacagaggcagcacccccacatcaccctactccgtccctcagatcgccccccttcccagcagcacgctgtgtcccatatgcaagacttcggacctcacgtcgacccccagccagccaaacttcaacacctgcacccagtgtcacaacaaggtctgcaaccagtgtgggttcaaccccaaccctcatctcacccaggtgaaggagtggctctgtctgaactgtcagatgcagagggctctgggaatggacatgaccactgcacctcgctccaagagccagcagcagctgcactccccagccctgtctcctgcccactccccggccaaacagcccctggggaagccagaccaagagagatctcggggcccaggaggaccacagcctgggtcccgccaggctgagacagccagggccacctcagtgccggggcctgcccaagcagctgcccctccagaggtggggagggtgtctcctcagccccctcaacccaccaagccttccacagctgagcccaggccacctgcaggagaggccccggccaaaagtgccaccgcagtgcccgctgggcttggtgccactgagcagacccaggagggcctcactggtaagctcttcggccttggcgcgtcactgctaacccaggcgagcaccctcatgtctgtgcagcccgaggctgacacccagggccagcctgcccccagcaaggggacacctaagatcgtcttcaatgatgccagcaaggaggctggcccaaaacccttgggctcagggcccgggcctgggccagcacctggagccaaaactgagcctggggctagaatgggtcctggatctggacctggagccctgccgaaaactgggggaacaaccagtccaaagcatggcagagcagaacatcaggcagcatcgaaggctgctgccaagccaaagaccatgccgaaggaaagggccatctgcccactgtgccaagccgagctcaacgtgggcagcaagagcccagccaactataacacatgcaccacctgcaggctccaggtgtgcaacctgtgtggcttcaacccaacaccccacctggtggagaaaacagagtggctctgtctgaactgccaaaccaagcggctactggagggcagcctaggagagccgacccccctgccgccgcccacctcacagcagccccctgtaggggcccctcaccgtgcatctggaacatcccctctgaagcagaaagggccacaggggctgggccagccttcaggccccctgcctgccaaggccagccctctatccaccaaggccagccctctgcccagcaaggccagcccccaggccaagcccctcagggcttctgaacccagcaagaccccaagcagtgtccaggaaaagaagacccgagtccccactaaagctgagcccatgccgaagccacctccagagactaccccaacccctgcgactcctaaagtaaagagtggggtgaggagggctgaacctgccacccctgtcgtcaaggctgttccagaagcccccaagggtggggaggcggaggacctggtgggcaagccttactctcaggatgcgtctcggagcccacagagcctcagtgacacaggctattcctctgacggcatctctagctcccagagtgagatcacaggagtcgtgcagcaggaggtggaacagctggacagtgcaggggtgacagggccacatccacccagcccctccgagatccacaaggtggggagcagcatgcggcctttgctgcaggcccagggcctggccccaagtgagcggagcaagccactctccagcggtactggcgaggagcagaagcagcggccccactccttgtccatcacgcctgaggcctttgactctgatgaggagctggaggatatcctggaggaagacgaagactctgctgagtggaggcgccggagagagcagcaggacactgccgagtcctcagacgactttggcagccaattgaggcacgactatgtggaggacagcagtgagggtggcctgtcccctcttccaccccagcccccagcccgggcagcagaactgactgatgaggatttcatgcgacggcagattctcgagatgagcgccgaggaagacaacctggaggaggatgacactgccacctccgggcgtggcctggccaaacatggcacccagaaaggtggccccagacccaggcctgagcctagccaagaaccagcagcactgcccaagaggcgcctgccccacaatgccaccacgggctatgaggagctgctccctgagggaggctcagcagaggctaccgatggcagtgggaccctgcagggtgggctccgtcgcttcaagaccattgagctcaacagcacgggaagttatggtcatgagttggacctgggccaaggcccagaccccagtctggaccgggagcctgagctggagatggagagcctaacgggctcccctgaggaccgctcccgtggtgagcactcctctacattgcctgcctccacacccagctacacctcgggcacctctcccacctctctgtcctccctagaggaggacagtgacagcagccccagccgcaggcagcgtctagaagaagcaaagcagcagcgcaaggcccggcaccgctcccacgggcccctgctacccaccatcgaggactcctcagaggaggaggagctgcgggaggaagaggagctgcttcgtgagcaagagaagatgcgggaggtggagcagcagcgcatccgcagcacagcccgcaagacccggcgggacaaggaagaactgcgggcccagcggaggcgagagcgctccaagacaccacccagtaacttgtcacccatcgaggatgcctccccgacggaggagctgaggcaggcggccgagatggaggagctacaccgctcctcctgctctgagtactcaccctcaccctcccttgactctgaggctgaggccttggatggtggccctagccggctttacaagtcaggcagtgagtacaacctgcccaccttcatgtccctctactcaccaaccgagacaccctccggcagctccaccactcccagttccggacggccgctcaagagcgctgaggaggcttatgaggagatgatgcgcaaagctgagctgctccagaggcagcaaggccaggcagcaggggcccggggaccccatggcggcccctctcagcccacaggcccccggggcctgggctccttcgaatatcaagacactacagaccgtgagtatggccaggctgctcagcctgccgcagagggcacgccagccagcctgggagcagccgtgtacgaagaaatccttcagacatcacagagcatagtccgcatgcggcaggcctcctcacgagacctggcttttgctgaggacaaaaagaaggagaagcagtttctaaatgctgagagtgcatacatggacccaatgaagcaaaatggtggcccccttacccctggtaccagtcccacccagctcgctgcccctgtgtccttctctacccccacctcctcagacagcagcgggggccgagttattcccgatgtccgtgtcactcagcattttgcaaaggagactcaggaccccctcaagctgcacagctctcctgcctcccccagctcagcctccaaggagataggcatgcccttttcccagggccctgggaccccagccaccacagctgtggctccttgtccagctgggctgccacgaggatatatgactccagcctccccagcaggctccgagcgtagtccttcaccatcttccacagcccacagctatggacacagcccaaccactgcaaactatgggtcccaaactgaggatctaccccaggcccccagtggccttgctgcagctggacgagctgctagagagaagcccttgagtgcgagtgacggtgagggtggcactcctcagccttcccgggcatattcctactttgcaagctccagcccacctctctccccgtcttccccctcagagagtcccacattctcccctggcaagatgggcccaagggccacagcagagttctctacacagacgccaagtccagcccctgcctcagacatgccacggagccctggtgcccccactccatcacctatggtagcccagggtacacaaacaccacatcgacccagcacgcctcgcctggtgtggcaggagtcctctcaagaggctccctttatggtcatcacgctggcatctgacgcctccagccagaccaggatggtacatgccagtgcctccacctccccgctctgctcacctactgaaacccagcccaccacccatggctacagccagacaacacctccgagtgtgtctcagctgcccccagagccacctgggccacctggctttccacgggtgcccagtgctggtgcagatgggcccctggcactatatggctggggtgccctccctgctgagaacatctccctgtgccggatctcctctgtccctgggacgtctagggttgagccaggccccaggacccctggcactgcagtggtagacctccgtacagctgtcaagcccactcccatcatcctcactgaccagggcatggacctcacctctcttgctgtggaagcgaggaagtatggtcttgccctggatccaatcccaggacggcagtcgaccgccgtgcagcccttggttatcaacctcaatgcccaggagcataccttccttgctactgccaccaccgtgagcatcaccatggcctcgtctgtgttcatggctcaacaaaagcagcctgtggtctatggagacccctaccagagccgccttgactttggccagggtgggggtagccctgtgtgcctggcccaggtcaaacaagtagagcaggctgtccagacagccccataccgaagtgggccccggggaagacccagggaggccaagtttgccagatataacctacccaaccaagtagctcctctggccagaagagacgttttgatcactcagatgggcaccgcccagagcattggcctcaagccaggcccagtgccagagccaggtgccgagccccaccgggccacccctgcagagctgcggtcacatgctctgccaggtgccaggaagccacacacagtggtggtgcagatgggagagggcacagcaggcactgtgaccacactgctcccagaggagcctgcgggtgccctggaccttaccgggatgaggcctgagagccagctggcatgctgtgacatggtctacaagctcccctttggcagcagctgcactggcaccttccacccggcccccagtgtgcctgagaagagcatggcagatgctgccccacctggccaaagcagcagccccttctatggtccccgggaccctgagcctcctgagcccccaacctaccgggcacagggggtggtggggcctgggccccatgaggagcagaggccctacccacaaggcctgcctggtaggctgtactcctccatgtctgacaccaatttggctgaggctggcctcaactaccatgcccagaggatcgggcagctcttccagggtcctggacgagactcggctatggacctcagctcactgaagcactcctacagcctgggctttgcggatggacgctacctagggcagggcttgcagtatggctcagtcacggacctgcgtcatcctacagaccttttggctcacccgcttcccatgcggcgctatagctcagtgtcgaacatctactcagaccacaggtacggcccacggggagatgcagttggcttccaggaggccagcctggcccagtacagtgccaccacagcccgtgaaatcagtcgcatgtgcgctgccctcaactccatggaccagtatggtgggcggcatggcagtggtggtggtggccctgaccttgtgcagtaccagccccagcacgggcccgggctcagtgctccacagagtctggttcccctcagacctggactccttggtaaccccacctttccagagggccacccaagtcctgggaacttggcccagtatgggcctgcagcaggccaaggaacagcagtcagacagctgctgccgtccacagccactgtacgtgcagctgatggcatgatctactcgactatcaataccccaattgctgcaacactgcccatcaccacccagcctgcctcagtcctgcggcccatggtgcgtggtggcatgtacaggccttacgcatctggtggaatcacagccgtgccactcaccagtctgacacgtgtgcccatgattgccccccgggtacctcttggacccacagggctgtaccgctatcctgcaccaagtagatttcccattgcttccagtgttccacctgcagaagggcctgtctatctggggaaacctgctgctgccaaggcccctggggctgggggcccttcaaggccagagatgccagtaggggctgcacgggaagagcctcttcccacaaccacccctgctgccatcaaggaggctgcaggagccccagctcctgccccactagctggccagaagccaccagcagatgctgctcctgggggtggcagtggggccctcagccggccagggttcgagaaagaggaagcatcacaggaggagaggcagcggaagcaacaggagcagctgctccagctagagcgggagcgggtggagttggagaagctgcgacaacttcggctgcaagaggagctagagcgggaacgtgtggagctgcagaggcaccgtgaggaggagcagctgctggtgcagcgggagttgcaggagctgcagaccatcaagcaccatgtgctgcagcagcagcaagaggaacgccaggctcaatttgcactgcagcgggaacagctagcgcagcagcgtctgcagctggagcagatccagcagctgcagcagcagctgcagcagcagctagaggagcagaagcagcggcagaaggctccctttcctgcagcctgtgaggcacctggccgagggcctcccctagcggctgctgagttggcccagaatggccagtattggcccccccttacacatgcagccttcattgccatggcagggcctgaaggacttgggcagcctcgtgagcctgtgctgcaccggggtctccccagctctgcctcagacatgtcactgcaaacggaggagcagtgggaggccagccgtagtggcatcaagaagcggcactccatgccacgcctgcgggatgcctgtgagctagagtctgggactgagccctgtgtggtcaggaggattgccgacagcagcgtgcagacagacgatgaggatggggagagccgctacctcttgagtcggcgacgccgggcacggcggagtgctgactgcagtgtgcagacggacgacgaagacagtgctgagtgggagcagccagtgcgccgccgcaggtctcgtcttccccgccactcagactcaggctctgacagcaagcacgatgccactgcctcatcatccagtgctgctgccactgtgagggccatgagcagcgtgggcatccagaccatcagtgactgctccgtgcagacggagcctgaccagctgcccagggtctctccagccatccacatcacagctgccaccgatcccaaggtggagatcgtcaggtacatatcggcgccagagaagactgggcgtggggagagcctggcctgccagacggagccagatgggcaggcccagggtgtagccgggccgcagcttgtagggccaactgccatcagcccctacctgcctggcatccagatcgtcaccccagggcctctgggcagatttgaaaaaaagaagccagatcccctggagattgggtaccaggcccacctgcctccggagtctctctcacagcttgtgagccgccagcctcccaagtcccctcaggtcctctactcaccagtctcacccctgtcccctcaccggctcctggacacctcctttgcttccagtgagaggctgaacaaagctcacgtgagtccccagaagcacttcacggctgacagcgctctccgccagcagacgctgcctcgccccatgaagaccctgcagcggtccctgtctgaccctaagcccctcagccccaccgccgaagagtctgccaaagagagattctccctctaccagcaccaggggggactgggtagccaggtgtcggcgttgccacccaacagcctggtccgcaaggtgaagcggacactgcccagcccccctccagaggaggctcaccttcccctggctggccaggcctccccacagctgtatgcagccagcctgctgcagcgagggctgacggggcccaccactgtccctgctaccaaggccagcctgctccgggagctggaccgggacctgcggctggtggagcatgagtccaccaaactgcgcaagaagcaggcagagctggatgaggaggagaaggagattgacgccaagctcaagtacctggagttgggtatcacacaacgcaaagagtctttggccaaagaccggggtggccgtgactacccacccttgcgtggtcttggcgagcatcgtgactacctatcggacagtgagctcaaccagctgcggctccagggctgcaccactcccgctggccagtttgtggacttccctgccactgccgctgctcctgccaccccctctggtcccactgccttccagcagccccgcttccagcctccagccccacagtattctgcaggcagtggtgggccaactcagaacggattcccagcccaccaggcccccacctaccctggccccagcacgtacccagctcctgcctttcctcctggtgccagttacccagctgagcctggcctgccaaaccagcaggctttccgccccacaggccactatgcaggccaaacacccatgccaaccacacagagcaccctttttccagtccccgctgatagccgtgccccactgcagaagccacgccagacatcgctagccgacttggagcagaaggtgcccaccaactatgaggtgatcgccagccccgttgtgcccatgtcttcagccccatctgaaaccagctacagtggcccagcagtgagcagcggctatgagcagggcaaggtccctgaggtgccccgggctggtgaccgtggcagtgtgagccagagcccagcccccacctacccctctgactcacactataccagtctggagcagaacgttcctcgaaactacgtaatgattgatgacatcagtgaactgaccaaggacagcacctctactgctcctgatagccaacggctggagcccctggggccaggcagcagtgggcgtccagggaaggagcctggagaaccaggtgtccttgacgggcccacactgccctgctgctatgccagaggagaagaggaatctgaggaggactcatacgatccccgcgggaagggtggccacctccggagcatggagagcaatggtcgaccagccagtacccactactatggtgacagtgactacaggcatggggctcgagtagagaagtatggtccagggcccatggggcccaagcatccctccaagagcctggctccagctgccatctcctcaaagcgcagcaagcaccggaagcagggcatggagcaaaagatatccaagttctcgcctattgaagaggccaaagacgtagagtcagacctggcgtcctaccccccacctgcagtcagcagcagcctggtctctcggggcaggaagttccaggatgaaatcacctatgggctcaagaagaacgtgtatgagcagcaaaaatactatgggatgtccagccgggacgcagtggaggacgaccgcatttatggcgggagcagccggtcccgggcaccttctgcatacagtggggagaagctgtccagccacgacttcagtggctggggcaaggggtacgaaagggaacgggaggctgtggagcgacttcaaaaagcgggccccaagccctcatccctaagtatggcccacagccgggtacgaccccccatgcggagccaggcctctgaagaggagagccccgtcagtcctttggggaggccccgccctgccggagggcccctccctcccggcggggatacctgcccacagttctgctccagccactccatgcctgatgtccaggaacatgtcaaggacggacctcgggcccacgcatataagcgtgaggagggctacatcctggatgattcccattgcgtggtttccgacagcgaagcgtatcacctgggccaggaggagacggactggtttgataagccccgggatgcccgctctgaccggttcaggcaccacgggggccatgcagtttcctcctcctcccagaagcgaggccctgccaggcacagctaccatgactacgatgaaccccctgaggagggcctgtggcctcatgatgagggtggcccaggccgccatgcctcagccaaggaacaccggcacggtgaccacgggcggcactcaggccgccacactggtgaggagccgggacggcgtgctgccaaaccacacgctcgggacctgggtcgccatgaggcccggccccactctcagcccagctctgctccagctatgccgaagaagggtcagcctgggtatcccagctctgctgagtactcacagccatcccgtgcttcatccgcataccatcatgcctctgacagcaagaagggctcccggcaagcccactccgggcccgctgcactgcagtcaaaggcagaaccccaggcgcagccgcagctgcaaggtcggcaggcagctccaggaccacagcagtcacagtcaccatcatccaggcaaataccctctggggcagcatcacgccagccacagacacagcagcagcagcaaggtcttgggctgcagcccccacagcaggctctgacacaggctcggctgcagcaacagagccagccaaccacccggggctcagcccctgctgccagccagcctgcagggaagcctcagccaggccccagcacagccacaggtcctcaaccagcaggaccgccacgggcagaacagacaaatggctctaaagggacagccaaagcaccgcaacaggggagggctcctcaggcccagccaacaccaggacctggacctgcaggtgtgaaggctggagccaggcctggaggaaccccaggggctcccgccggccagccaggtgccgatggggagagcgtgttctccaagatcctccctggcggggcagccgagcaagctggcaaactgacggaagctgtctctgcttttggcaaaaaattttcctcattctggtgaccatgcccagcatggctcttgaagaaatgaagagaggtatcattgctgtggaaaaatctctggagtcagaggcctgggcgcagctctggactctgcgtataacacatctacaatctggcaaacccttggcccaaagactcaccaggtgggacgtggcaggcaggcctcagttgaggacgtgatgttttctcacagcagctgcctgggtgaagcatctgctggacaagtcggaccactggccaggggacctttgattgtctttccagagatgctgctctctgcagggcaccaccttcaaggcacagcccttgttgggagggagaaccctctccagaaaccctgccaccatggtgtcttgccgtacttcccacagccgcctttttgcggcctggccggccaggcttcccgtgcgttatacacagagtttgggcacacactgccctccctccgagatgccagaagtttttccacagccttggagaggggctttgactgagggctgggggccctgggctccgtttccttcacattccagctggcccggatccctctgtggcacagggccctgcccgtcacatgccctctgggtgacatcggagcagacctccatgtggccaggggttgggagaactttacaaacattaggacctaacactgtctcatcgctgaaataagaggccatagcaccgaaaagcagcgtgggcgccggctgaggcttctcccagcccgtgggtggcagcgtgctagcacactgccaccatctcaaagccatccccctagccatcgtgagcatcccagcggcaccgccattgtctcaaccagccggctcctcgtctgtacacctggggatttcttttgatttcaagaacagccttaatcattccagtttgatttacgtgtatacctcataaacatttttcttttgtttctctctccccctttctctcttctcttggctcactcccttgcctctccccctccaccaccaccttgtgactgatggtttggtttcctctctgctctgcccctgctcagcacagggagaatgttgacttagaagcaatagggggcagcaggccaccaagagcacaaccccagggcgaggtctggggaggcctcccagcccgcctctgtttactgtgcaattccagtcgttcttaagccatcaccagtgggtgtactcagagcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgta

SEQ ID NO: 449814 - DNA, 8298 bp, Homo sapiens
ttctggtggtgatggggcttggcagggtcacctagcttggtagagacctccgcaagctgcttctctaagctgtatctctaacagtcattttcaatgtcatttcagcacttcccggagactggaccccaaggaacccctgggtaaccagagagcagcttccccaactccgaagcaggcttctgctaccactcctggccatgagagcccccgagagacaagggcacagggaccagcaggccaggaggctgatggtccccgcaggacgctgcaggtagacagcaggacacagagatcagggcggtccccctcagtgtcaccggacagaggcagcacccccacatcaccctactccgtccctcagatcgccccccttcccagcagcacgctgtgtcccatatgcaagacttcggacctcacgtcgacccccagccagccaaacttcaacacctgcacccagtgtcacaacaaggtctgcaaccagtgtgggttcaaccccaaccctcatctcacccaggtgaaggagtggctctgtctgaactgtcagatgcagagggctctgggaatggacatgaccactgcacctcgctccaagagccagcagcagctgcactccccagccctgtctcctgcccactccccggccaaacagcccctggggaagccagaccaagagagatctcggggcccaggaggaccacagcctgggtcccgccaggctgagacagccagggccacctcagtgccggggcctgcccaagcagctgcccctccagaggtggggagggtgtctcctcagccccctcaacccaccaagccttccacagctgagcccaggccacctgcaggagaggccccggccaaaagtgccaccgcagtgcccgctgggcttggtgccactgagcagacccaggagggcctcactggtaagctcttcggccttggcgcgtcactgctaacccaggcgagcaccctcatgtctgtgcagcccgaggctgacacccagggccagcctgcccccagcaaggggacacctaagatcgtcttcaatgatgccagcaaggaggctggcccaaaacccttgggctcagggcccgggcctgggccagcacctggagccaaaactgagcctggggctagaatgggtcctggatctggacctggagccctgccgaaaactgggggaacaaccagtccaaagcatggcagagcagaacatcaggcagcatcgaaggctgctgccaagccaaagaccatgccgaaggaaagggccatctgcccactgtgccaagccgagctcaacgtgggcagcaagagcccagccaactataacacatgcaccacctgcaggctccaggtgtgcaacctgtgtggcttcaacccaacaccccacctggtggagaaaacagagtggctctgtctgaactgccaaaccaagcggctactggagggcagcctaggagagccgacccccctgccgccgcccacctcacagcagccccctgtaggggcccctcaccgtgcatctggaacatcccctctgaagcagaaagggccacaggggctgggccagccttcaggccccctgcctgccaaggccagccctctatccaccaaggccagccctctgcccagcaaggccagcccccaggccaagcccctcagggcttctgaacccagcaagaccccaagcagtgtccaggaaaagaagacccgagtccccactaaagctgagcccatgccgaagccacctccagagactaccccaacccctgcgactcctaaagtaaagagtggggtgaggagggctgaacctgccacccctgtcgtcaaggctgttccagaagcccccaagggtggggaggcggaggacctggtgggcaagccttactctcaggatgcgtctcggagcccacagagcctcagtgacacaggctattcctctgacggcatctctagctcccagagtgagatcacaggagtcgtgcagcaggaggtggaacagctggacagtgcaggggtgacagggccacatccacccagcccctccgagatccacaaggtggggagcagcatgcggcctttgctgcaggcccagggcctggccccaagtgagcggagcaagccactctccagcggtactggcgaggagcagaagcagcggccccactccttgtccatcacgcctgaggcctttgactctgatgaggagctggaggatatcctggaggaagacgaagactctgctgagtggaggcgccggagagagcagcaggacactgccgagtcctcagacgactttggcagccaattgaggcacgactatgtggaggacagcagtgagggtggcctgtcccctcttccaccccagcccccagcccgggcagcagaactgactgatgaggatttcatgcgacggcagattctcgagatgagcgccgaggaagacaacctggaggaggatgacactgccacctccgggcgtggcctggccaaacatggcacccagaaaggtggccccagacccaggcctgagcctagccaagaaccagcagcactgcccaagaggcgcctgccccacaatgccaccacgggctatgaggagctgctccctgagggaggctcagcagaggctaccgatggcagtgggaccctgcagggtgggctccgtcgcttcaagaccattgagctcaacagcacgggaagttatggtcatgagttggacctgggccaaggcccagaccccagtctggaccgggagcctgagctggagatggagagcctaacgggctcccctgaggaccgctcccgtggtgagcactcctctacattgcctgcctccacacccagctacacctcgggcacctctcccacctctctgtcctccctagaggaggacagtgacagcagccccagccgcaggcagcgtctagaagaagcaaagcagcagcgcaaggcccggcaccgctcccacgggcccctgctacccaccatcgaggactcctcagaggaggaggagctgcgggaggaagaggagctgcttcgtgagcaagagaagatgcgggaggtggagcagcagcgcatccgcagcacagcccgcaagacccggcgggacaaggaagaactgcgggcccagcggaggcgagagcgctccaagacaccacccagtaacttgtcacccatcgaggatgcctccccgacggaggagctgaggcaggcggccgagatggaggagctacaccgctcctcctgctctgagtactcaccctcaccctcccttgactctgaggctgaggccttggatggtggccctagccggctttacaagtcaggcagtgagtacaacctgcccaccttcatgtccctctactcaccaaccgagacaccctccggcagctccaccactcccagttccggacggccgctcaagagcgctgaggaggcttatgaggagatgatgcgcaaagctgagctgctccagaggcagcaaggccaggcagcaggggcccggggaccccatggcggcccctctcagcccacaggcccccggggcctgggctccttcgaatatcaagacactacagaccgtgagtatggccaggctgctcagcctgccgcagagggcacgccagccagcctgggagcagccgtgtacgaagaaatccttcagacatcacagagcatagtccgcatgcggcaggcctcctcacgagacctggcttttgctgaggacaaaaagaaggagaagcagtttctaaatgctgagagtgcatacatggacccaatgaagcaaaatggtggcccccttacccctggtaccagtcccacccagctcgctgcccctgtgtccttctctacccccacctcctcagacagcagcgggggccgagttattcccgatgtccgtgtcactcagcattttgcaaaggagactcaggaccccctcaagctgcacagctctcctgcctcccccagctcagcctccaaggagataggcatgcccttttcccagggccctgggaccccagccaccacagctgtggctccttgtccagctgggctgccacgaggatatatgactccagcctccccagcaggctccgagcgtagtccttcaccatcttccacagcccacagctatggacacagcccaaccactgcaaactatgggtcccaaactgaggatctaccccaggcccccagtggccttgctgcagctggacgagctgctagagagaagcccttgagtgcgagtgacggtgagggtggcactcctcagccttcccgggcatattcctactttgcaagctccagcccacctctctccccgtcttccccctcagagagtcccacattctcccctggcaagatgggcccaagggccacagcagagttctctacacagacgccaagtccagcccctgcctcagacatgccacggagccctggtgcccccactccatcacctatggtagcccagggtacacaaacaccacatcgacccagcacgcctcgcctggtgtggcaggagtcctctcaagaggctccctttatggtcatcacgctggcatctgacgcctccagccagaccaggatggtacatgccagtgcctccacctccccgctctgctcacctactgaaacccagcccaccacccatggctacagccagacaacacctccgagtgtgtctcagctgcccccagagccacctgggccacctggctttccacgggtgcccagtgctggtgcagatgggcccctggcactatatggctggggtgccctccctgctgagaacatctccctgtgccggatctcctctgtccctgggacgtctagggttgagccaggccccaggacccctggcactgcagtggtagacctccgtacagctgtcaagcccactcccatcatcctcactgaccagggcatggacctcacctctcttgctgtggaagcgaggaagtatggtcttgccctggatccaatcccaggacggcagtcgaccgccgtgcagcccttggttatcaacctcaatgcccaggagcataccttccttgctactgccaccaccgtgagcatcaccatggcctcgtctgtgttcatggctcaacaaaagcagcctgtggtctatggagacccctaccagagccgccttgactttggccagggtgggggtagccctgtgtgcctggcccaggtcaaacaagtagagcaggctgtccagacagccccataccgaagtgggccccggggaagacccagggaggccaagtttgccagatataacctacccaaccaagtagctcctctggccagaagagacgttttgatcactcagatgggcaccgcccagagcattggcctcaagccaggcccagtgccagagccaggtgccgagccccaccgggccacccctgcagagctgcggtcacatgctctgccaggtgccaggaagccacacacagtggtggtgcagatgggagagggcacagcaggcactgtgaccacactgctcccagaggagcctgcgggtgccctggaccttaccgggatgaggcctgagagccagctggcatgctgtgacatggtctacaagctcccctttggcagcagctgcactggcaccttccacccggcccccagtgtgcctgagaagagcatggcagatgctgccccacctggccaaagcagcagccccttctatggtccccgggaccctgagcctcctgagcccccaacctaccgggcacagggggtggtggggcctgggccccatgaggagcagaggccctacccacaaggcctgcctggtaggctgtactcctccatgtctgacaccaatttggctgaggctggcctcaactaccatgcccagaggatcgggcagctcttccagggtcctggacgagactcggctatggacctcagctcactgaagcactcctacagcctgggctttgcggatggacgctacctagggcagggcttgcagtatggctcagtcacggacctgcgtcatcctacagaccttttggctcacccgcttcccatgcggcgctatagctcagtgtcgaacatctactcagaccacaggtacggcccacggggagatgcagttggcttccaggaggccagcctggcccagtacagtgccaccacagcccgtgaaatcagtcgcatgtgcgctgccctcaactccatggaccagtatggtgggcggcatggcagtggtggtggtggccctgaccttgtgcagtaccagccccagcacgggcccgggctcagtgctccacagagtctggttcccctcagacctggactccttggtaaccccacctttccagagggccacccaagtcctgggaacttggcccagtatgggcctgcagcaggccaaggaacagcagtcagacagctgctgccgtccacagccactgtacgtgcagctgatggcatgatctactcgactatcaataccccaattgctgcaacactgcccatcaccacccagcctgcctcagtcctgcggcccatggtgcgtggtggcatgtacaggccttacgcatctggtggaatcacagccgtgccactcaccagtctgacacgtgtgcccatgattgccccccgggtacctcttggacccacagggctgtaccgctatcctgcaccaagtagatttcccattgcttccagtgttccacctgcagaagggcctgtctatctggggaaacctgctgctgccaaggcccctggggctgggggcccttcaaggccagagatgccagtaggggctgcacgggaagagcctcttcccacaaccacccctgctgccatcaaggaggctgcaggagccccagctcctgccccactagctggccagaagccaccagcagatgctgctcctgggggtggcagtggggccctcagccggccagggttcgagaaagaggaagcatcacaggaggagaggcagcggaagcaacaggagcagctgctccagctagagcgggagcgggtggagttggagaagctgcgacaacttcggctgcaagaggagctagagcgggaacgtgtggagctgcagaggcaccgtgaggaggagcagctgctggtgcagcgggagttgcaggagctgcagaccatcaagcaccatgtgctgcagcagcagcaagaggaacgccaggctcaatttgcactgcagcgggaacagctagcgcagcagcgtctgcagctggagcagatccagcagctgcagcagcagctgcagcagcagctagaggagcagaagcagcggcagaaggctccctttcctgcagcctgtgaggcacctggccgagggcctcccctagcggctgctgagttggcccagaatggccagtattggcccccccttacacatgcagccttcattgccatggcagggcctgaaggacttgggcagcctcgtgagcctgtgctgcaccggggtctccccagctctgcctcagacatgtcactgcaaacggaggagcagtgggaggccagccgtagtggcatcaagaagcggcactccatgccacgcctgcgggatgcctgtgagctagagtctgggactgagccctgtgtggtcaggaggattgccgacagcagcgtgcagacagacgatgaggatggggagagccgctacctcttgagtcggcgacgccgggcacggcggagtgctgactgcagtgtgcagacggacgacgaagacagtgctgagtgggagcagccagtgcgccgccgcaggtctcgtcttccccgccactcagactcaggctctgacagcaagcacgatgccactgcctcatcatccagtgctgctgccactgtgagggccatgagcagcgtgggcatccagaccatcagtgactgctccgtgcagacggagcctgaccagctgcccagggtctctccagccatccacatcacagctgccaccgatcccaaggtggagatcgtcaggtacatatcggcgccagagaagactgggcgtggggagagcctggcctgccagacggagccagatgggcaggcccagggtgtagccgggccgcagcttgtagggccaactgccatcagcccctacctgcctggcatccagatcgtcaccccagggcctctgggcagattgccagttccactgaaataatccagcttgaaccaagagcacacttgaagcattccttatcaaatctgtagactggagacaggatctcaaagaatttcagaatactttcttctctattaaggttggcaaattgtctaaatgtttgt

SEQ ID NO: 449815 - DNA, 879 bp, Homo sapiens
tggggtgaggagggctgaacctgccacccctgtcgtcaaggctgttccagaagcccccaagggtggggaggcggaggtcagtcccattcacttcccagagaccctagctttcagacaggacagtctatggaaaggcttgcctccctgggtggctgaggctgtaggctcaggacaggtgccttggggccacacaggagggaagggacacagtagaaggaaagtctagatgaggttctggcacgcttggagactgtgggttttacactggtgctgtgtctggcaccttgtcagatgctttgctgggttttgataccctttgatctagtaaagtttctctttgaagaccaagggctggtttgggcttgccatggaaccttcaggttattcaaggccagaaggagatagggtgggtggcgggccctaaacccttgggaaatggacagactcttccccagggtcctgggattgacagggaggattgggttcccaccacgagctttgccatggggagtcagtgtctgcttttcaccctgctgcaggacctggtgggcaagccttactctcaggatgcgtctcggagcccacagagcctcagtgacacaggctattcctctgacggcatctctagctcccagagtgagatcacaggagtcgtgcagcaggaggtggaacagctggacagtgcaggggtgacagggccacatccacccagcccctccgagatccacaaggtggggagcagcatgcggcctttgctgcaggcccagggcctggccccaagtgagcggagcaagccactctccagcggtactggcgaggagcagaagcagcggccccactccttgtccatcacgcctgaggcctttgactctgatgagg

SEQ ID NO: 449816 - DNA, 572 bp, Homo sapiens
gaaaagaatagattatgaaattagactattaatgaagacttaatttttgctcactgaatgtgtagatgtcaattccattaactaagatgggaaatatcaggtgggagggaaataagttgggaaaagtaggaaataaagggtctttgcttggaaaatgttaagtttggcatgcccattggatatccaagtggagagtttaagaagataattaaaaataaatgtttggtgctcagggcgaggtgaggactaaatcaataaatttggcatcatcaggatatggataaaatttaggcccggcgcggtggctcacgcctgtaatcccagtacttttggaggccaaggcgggcggatcatgatttcagaagattgagaccatcctggctagcacggtgaaaccctgtctgtactaaaaaaatacaaaaaattagccaggctttggtgacgggctgtagtcccagctgctccggaggctgaggtaggagaatggcgtgaacctgggaggcggcgcttgcagtgagccgagattgcgccgctgcactccagcctgggctacacagagagacttcgtctca

SEQ ID NO: 449817 - DNA, 1497 bp, Homo sapiens
gattaatgacctacaaaaagacatcgaaggcagtaggaaaagagaatctgagctgctgctgtttacagaaaggctcactagtaagaatgcacagcttcagtctgaatccaattctttgcagtcacaatttgataaagtttcctgtagtgaaagtcagttacaaagccagtgtggacaaatgaaacagacaaatattaatttggaaagtaggttgttgaaagaggaagaactgcgaaaagaggaagtccaaactctgcaagctgaactcgcttgtagacaaacagaagttaaagcattgagtacccaggtagaagaattaaaagatgagttagtaactcagagacgtaaacatgcctctagtatcaaggatctcaccaaacaacttcagcaagcacgaagaaaattagatcaggttgagagtggaagctatgacaaagaagtcagcagcatgggaagtcgttctagttcatcagggtccctgaatgctcgaagcagtgcagaagatcgatctccagaaaatactgggtcctcagtagctgtggataactttccacaagtagataaggccatgttgattgagagaatagttaggctgcaaaaagcacatgcccggaaaaatgaaaagatagaatttatggaggaccacatcaaacaactggtggaagaaattaggaaaaaaacaaaaataattcaaagttatattttacgagaagaatcaggcacactttcttcagaggcatctgattttaacaaagttcatttaagtagacggggtggcatcatggcatctttatatacatcccatccagctgacaatggattaacattggagctctctttggaaatcaaccgaaaattacaggctgttttggaggatacgttactaaaaaatattactttgaaggaaaatctacaaacacttggaacagaaatagaacgtcttattaaacaccagcatgaactagaacagaggacaaagaaaacctaaaacaagcctcttgctcagtaaagagacaaaagccacacaggagtaggtgccactgacctctattgttggagactttgttccactttttgtttcagccagtaaaaatattgttttgcttcatctgtacacaaaaaaatacccttttacaatatgaatgcattgctgtatatactgtaagactgaaagctttgatgaaatttgtttttgtatggtgcaatatgacagcctgtcattgaatctaaacaacttaatttgcttgtattcataagaagtgttgaacattacaagggcttttataaaaaaccctttgttcatatttcttccctttaaaatatgtaatgtcaaaaatgactcaccttttaaaaattatgcatgaaaacaggtggtaaacattcagtaatacgctatttctccaacatcaagacaactaaaacaaatgataaaaatgtttatttttacactccagcatatcgggtgagttttagggatgtgtatgaatatttaaatct

SEQ ID NO: 449818 - DNA, 513 bp, Homo sapiens
gattaatgacctacaaaaagacatcgaaggcagtaggaaaagagaatctgagctgctgctgtttacagaaaggctcactagtaagaatgcacagcttcagtctgaatccaattctttgcagtcacaatttgataaagtttcctgtagtgaaagtcagttacaaagccagtgtggacaaatgaaacagacaaatattaatttggaaagtaggttgttgaaagaggaagaactgcgaaaagaggaagtccaaactctgcaagctgaactcgcttgtagacaaacagaagttaaagcattgagtacccaggtagaagaattaaaagatgagttagtaactcagagacgtaaacatgcctctagtatcaaggatctcaccaaacaacttcagcaaggtataaaattcttccacacttagaccatgaatgtgtttgtttcttttaatcattaggattttattttttgtgattctgccacattgattgaagctgtatgttttctttgttaatattagta

SEQ ID NO: 449819 - DNA, 695 bp, Homo sapiens
tgttagtcttttatatatattagaacatatgaaaaatagaaatttaaaataatctatttttaaatatcagtataaatagcagttctgatatcttcttttacattcctgtgatttcttttgtgctgcatctaggctaccggcatctagggtgcagatacccgagatgcgtcctctgacttggaaatcgttgcgacttaactcttcacctgggtttcaagaaacagaccccagaaagttataaattacccagacataacaattgactgctgaactggattccagatttctttcttttaaaaagtcatacagtcattgggtgtctgtgctatatgcttgggatacaaaaataaataagacacgtatttcaacctcctattctctactatttctcacggctttatttgtgttaaaatagggtgaaatatagtaataagctaaaagggacttagcatttacttaatacaaatatattcagatatttgccatagagtttagtttgtttttatagatgtaattgaagggaaatttggaagaaatttctggtactgtaaggaacttctaaatctttcaatactttaaaaagttaactccactgtaattaagtgatgccagtgtcagttataatgttgtttctgtatattttgtacttgacttttacatttccaaatgacattttatatgaatgacatagccct

SEQ ID NO: 449820 - DNA, 346 bp, Homo sapiens
taattaagtgatgccagtgtcagttataatgttgtttctgtatattttgtacttgacttttacatttccaaatgacattttatatgaatgacatagccctctgcctaaagtatgtattcaagaactttctcttgtctatgccatttttgcctcagtgattttagcaattaaagtcagagatggtaggagcaaatggtcctgataattgtgacgaataatcttctttttcctatagcacgaagaaaattagatcaggttgagagtggaagctatgacaaagaagtcagcagcatgggaagtcgttctagttcatcaggtaaaaaactagtggctctagttgttattt

SEQ ID NO: 449821 - DNA, 955 bp, Homo sapiens
gattaatgacctacaaaaagacatcgaaggcagtaggaaaagagaatctgagctgctgctgtttacagaaaggctcactagtaagaatgcacagcttcagtctgaatccaattctttgcagtcacaatttgataaagtttcctgtagtgaaagtcagttacaaagccagtgtggacaaatgaaacagacaaatattaatttggaaagtaggttgttgaaagaggaagaactgcgaaaagaggaagtccaaactctgcaagctgaactcgcttgtagacaaacagaagttaaagcattgagtacccaggtagaagaattaaaagatgagttagtaactcagagacgtaaacatgcctctagtatcaaggatctcaccaaacaacttcagcaaggctaccggcatctagggtgcagatacccgagatgcgtcctctgacttggaaatcgttgcgacttaactcttcacctgggtttcaagaaacagaccccagaaagttataaattacccagacataacaattgactgctgaactggattccagatttctttcttttaaaaagtcatacagtcattgggtgtctgtgctatatgcttgggatacaaaaataaataagacacgtatttcaacctcctattctctactatttctcacggctttatttgtgttaaaatagggtgaaatatagtaataagctaaaagggacttagcatttacttaatacaaatatattcagatatttgccatagagtttagtttgtttttatagatgtaattgaagggaaatttggaagaaatttctggtactgtaaggaacttctaaatctttcaatactttaaaaagttaactccactgtaattaagtgatgccagtgtcagttataatgttgtttctgtatattttgtacttgacttttacatttccaaatgacattttatatgaatgacatagccct

SEQ ID NO: 449822 - DNA, 860 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagcgcctgcctctccaggatgtctacaaaattggtggtattggtactgttcctgttggccgagtggagactggtgttctcaaacccggtatggtggtcacctttgctccagtcaacgttacaacgcggacatgttaacacacaacaaacatcgccccctggtcgaaaatgcaccatgaagctttgagtgaagctctttccttgggcgggaacccacaaacaattttggggttttgggggggggggggcccccctttttttttttccccccacaacacaaacaaaacgttttttgtggggggggcgcccatttcttttcccgcccgccagaatacaaaacacacaaccgtgcgggcggtgcgtcccaacacaacaccacacccacaaccaccccgtctatcttgttgttggtgggggaggggccaccacattatcattggcgggggaccggcgccacgactattattactccccccccccgctcctcttacttccttgctcgcggggggggggcaccatatcctacgtctctcccccccacccctgtcacgaacaaatccctgcactcacgatacccgcgtgtcgcttatgtgacgtttagtatag

SEQ ID NO: 449823 - DNA, 1760 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449824 - DNA, 1688 bp, Homo sapiens
ctgccggtgcgactgtgagaggatcccctccaagacccaggcatacttgaaggagccctttcctggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449825 - DNA, 1722 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaatagataggtataatggatgaatagtatcttgttggacctatcgtttgagtttgtctgttgattgtcgtagtgagacagattgttaaaggttgagttatgttttatatataattctaagtacattttcttaacgtggaaacc

SEQ ID NO: 449826 - DNA, 1523 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggttatcagactataccaccgaaaaatctaaaaatttcttgttaagaaattaaattaggccaggcgtagtggctcacacctgtaatccgagcactttgggaggccgaggtgggcggatcatctgaggtctggagttcgagatcagcctggccaacatg

SEQ ID NO: 449827 - DNA, 1423 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtacccaaaggtggatagtctggcaagcccatgtgtgttgagagcttctcctcgtgc

SEQ ID NO: 449828 - DNA, 1706 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449829 - DNA, 1700 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449830 - DNA, 1727 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449831 - DNA, 1258 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggagcaagggtcaatgcatgaagttgtgagtgaagaaagatgtggcggttgtaaagtgaatggcttatttgaattgggagtgcatgtgagatgtcgggagccagttgttgga

SEQ ID NO: 449832 - DNA, 1619 bp, Homo sapiens
attctagacagtatcatttattgggaacaacatacattatcagcatgttgttgatatttggataatgaacaaaatcttggcttgtccattgctgacaacgaactgtatttagtgatcattttagatagtgatattatagcattcatctgtgtgtaaatatatttcatatagggaaggtagattctcgatctgtaatccttatggttcttagttggaagaacaaaattgggagtgtgctagtttgctgtgatgttatgaatacgagtttctactttattgggaaacatttgcaaaattaaatactgtatcactgtatgacatttaaaaatgttaatagaactggttagtattagaaagcagatcagtttcccaaaaattctaaagagcaagagtcttatgtagttgcttgtataatacgcctaggctgattattttaagatctgagacttccatggtggccctagttaggcatttaagcgactaccattgtgaccgcgtgctggtgtaataaagaagcttacgacatggtatcaactgtttgataccaaatgtatagtccctaaccactttttattatatgttgccaaatggtcgacattcgatgtgtgagccttccgattatagcataacatataaacactagagtgtatctagcaaaagacgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449833 - DNA, 1060 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactacggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449834 - DNA, 1512 bp, Homo sapiens
  misc_feature (837)..(837): n is a, c, g, or t
  misc_feature (839)..(839): n is a, c, g, or t
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtcncngactgcatcctaccaccaactcgtccaactcaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449835 - DNA, 1482 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccgctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449836 - DNA, 1214 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttcaatgtcaagaatgtgtctgtcaaggatgttcgtcgtggcaacgttgctggtgacagcaaaaatgacccaccaatggaagcagctggcttcactgctcaggtgattatcctgaaccatccaggccttgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449837 - DNA, 577 bp, Homo sapiens
cgatctagaggatccctatgtgattgtcatgatgtgattgtcatgatgtgattgttcatgatgtgattgtcatgatgtgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449838 - DNA, 578 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449839 - DNA, 531 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggctgtagggtggctcagtggaatccatctttgtgacaccgaccattagtg

SEQ ID NO: 449840 - DNA, 564 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449841 - DNA, 552 bp, Homo sapiens
actactactaaattcgcggccgcgtcgaccttctgaaggttttacgatgcattgttatcattaaccagtcttttactactaaacttaaatggccaattgaaacaaacagttctgagaccgttcttccaccactgattaagagtggggtggcaggtattagggataatattcatttagccttctgagctttctgggcagacttggtgaccttgccagctccagcagccttcttgtccactgctttgatgacacccaccgcaactgtctgtctcatatcacgaacagcaaagcgacccaaaggtggatagtctgagaagctctcaacacacatgggcttgccaggaaccatatcaacaatggcagcatcaccagaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449842 - DNA, 1734 bp, Homo sapiens
gcacgagaaaaaaaaaaaaaaaaaaaaaaaaaaaaaaaaaaaaaaaaaaaaaacctcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449843 - DNA, 1865 bp, Homo sapiens
  misc_feature (1737)..(1737): n is a, c, g, or t
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaagtnttggaaaaaaaaaaaaggggggggcaaaaaatctcgagggccacatacgaacccttttgaagaggccacaaggggagataaaaagacgggggtaaacgaggaaagagggttggaaaccctggggtgac

SEQ ID NO: 449844 - DNA, 1830 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaacacatcatggacaatcacatcatgaacaatcacatcatgaacaatcacatcatgaacaatcacatcatgaacaatcacatcatgaacaatcacatcatgaacaatcacatcatgaacaatcacatcatgaacaatcacatcatgaacaatcacatcatgaacaatcacatcatgaacaatcacatcatgaacaatcacatcatgaacaatcacatcatgaacaatcacatcatgacaagagatcctcta

SEQ ID NO: 449845 - DNA, 1716 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtagccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449846 - DNA, 1302 bp, Homo sapiens
  misc_feature (1244)..(1244): n is a, c, g, or t
  misc_feature (1255)..(1255): n is a, c, g, or t
  misc_feature (1280)..(1280): n is a, c, g, or t
  misc_feature (1283)..(1283): n is a, c, g, or t
  misc_feature (1302)..(1302): n is a, c, g, or t
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagttttggctggagcttgaaaaggaaaaaagaattggaattcgccccgtttccttgggttaaaaaaaancttgggaaaanaattgggcccccttaaaaatttccnttngaaaaattccttggggttn

SEQ ID NO: 449847 - DNA, 1729 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccttgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449848 - DNA, 1703 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtgtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449849 - DNA, 1602 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449850 - DNA, 1245 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaataataat

SEQ ID NO: 449851 - DNA, 1341 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacgtgtagtcgactacatacttccgccaccctccccgagttggtccctttgctgggtggggttagggccttcctccgtgtcctgtactttcagggtacctggtgggggtgtgtatcccagaggcaaaaactcttcccctctcacactctgggactcacagtccttcacctgactcacagtgtagactgcagcctcctgcgtccttcaaagcgtccctgggttttcctgttcaatgactgcatcgcctcttgaaaaaagttcacaaagtgaatgtctctacactattttgtccttccacgtgggagaggcgtgccagcaatgcctctcatccgccatcttgacagaaacagttaaaaaaccttattgcattttcagttcatgaaatgttcatttgcttctcccgaagtatgtacattcgg

SEQ ID NO: 449852 - DNA, 5899 bp, Homo sapiens
cggaggacagccggaccgagccaacgccggggactttgttccctccacggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgaggggcctacggaggcgcaggagcggtggtgatggtctgggaagcggagctgaagtcccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagtaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcatta

SEQ ID NO: 449853 - DNA, 961 bp, Homo sapiens
agtatgtgggcttaatactcactgtgtggtggacaccccaacctcaggtccccatcctagccactataggggcatctgcccaaggtgggtgggtggaaccaaaggggacagagtggaaccaggcaggcctgggtgtaggccttgggttctggtctccatagcctgctcacagatgtggctctgaatcaccggctccttttcttctgcagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggtgccttatgggggaagactcatatgcactgggaagtgatctaggggtctagagggaccacaagactcctcagtttgtttccctaagataacaaacttgaatgcagcaaactgtaattaccccgtctcttctctgttccaaagattctgtgaacttttctatattgtatttaatagttaatattaatttatggcatataacaaaattcatgagttgatcaattgactttggtctctaaataatttttagcttttttagctttagagcaggtacagtgatgttcactgaatccgagacaattctcattgaggactgacattggcaacacgctattaatttttagataaacaaagaaatagatgttttacttatttctatcatccgctgtgttgtaaaaagacaataaaccactcttgtctggcaatctcgatgctagaccaggtttaattaaacaa

SEQ ID NO: 449854 - DNA, 2976 bp, Homo sapiens
ccggtggtcctgcagactgttggatacggcagagccggtgacactgtgccgggcggagcgaagtgcgtgggttcctggctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcatta

SEQ ID NO: 449855 - DNA, 5845 bp, Homo sapiens
cggaggacagccggaccgagccaacgccggggactttgttccctccacggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgaggggcctacggaggcgcaggagcggtggtgatggtctgggaagcggagctgaagtcccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagtaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatcctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcatta

SEQ ID NO: 449856 - DNA, 2417 bp, Homo sapiens
cggaggacagccggaccgagccaacgccggggactttgttccctccacggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgaggggcctacggaggcgcaggagcggtggtgatggtctgggaagcggagctgaagtcccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagtaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggtgccttatgggggaagactcatatgcactgggaagtgatctaggggtctagagggaccacaagactcctcagtttgtttccctaagataacaaacttgaatgcagcaaactgtaattaccccgtctcttctctgttccaaagattctgtgaacttttctatattgtatttaatagttaatattaatttatggcatataacaaaattcatgagttgatcaattgactttggtctctaaataatttttagcttttttagctttagagcaggtacagtgatgttcactgaatccgagacaattctcattgaggactgacattggcaacacgctattaatttttagataaacaaagaaatagatgttttacttatttctatcatccgctgtgttgtaaaaagacaataaaccactcttgtctggcaatctcgatgctagaccaggtttaattaaacaa

SEQ ID NO: 449857 - DNA, 1624 bp, Homo sapiens
cggaggacagccggaccgagccaacgccggggactttgttccctccacggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgaggggcctacggaggcgcaggagcggtggtgatggtctgggaagcggagctgaagtcccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagtaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaaggtctggttctgttctgccgcatactggaggggtgggtcacagcgaccttgcccttccatatccaaggaaagaccccatctgcttctccattctcccttccaattggaagctccatactgtggggaaaatcacttctgtttagaaagtgatttgagtt

SEQ ID NO: 449858 - DNA, 444 bp, Homo sapiens
gtttttttgatctttaattcaaaaggatttctttttacttgttgtggttttactgttgtcaccccacatagcaggacaacccagtccaaaacctagaaaatcattacacctcaactctcagggttattgagatgccgattattactcaaattaggaatggtgtgggaaagtgaaaagagttcagataattttcacatttcttcccattgtaaataaaacaggccccttagatttttctcgggtgaaccaaaaaaccaaactgactcttttagttttggcaacagggaacagaggaagctttgcgacttctacacaaaaatgatggggatggcaccaggaggaagagaaaacctacagcaaaaagaccttcgtgcctttcttacatttatagttcatttatgtttcaagcaagttgtccacaataaacatgattaactttcataa

SEQ ID NO: 449859 - DNA, 267 bp, Homo sapiens
agtaatttttttcttgcctattctagcacgggacacctccattactcattgctgctggctgtgggaatattcaaatactacagttgctcattaaaagaggctcgagaatcgatgtccaggataaggtcataattgttttattgaaatgaattgaattttaaagtattttcaagtgtctcttaatcataggggtaacagaggaaaaaaatttatgtcctaacttgtttctcagtttcctgtaaaggaagatgagctgcttttaaacag

SEQ ID NO: 449860 - DNA, 1521 bp, Homo sapiens
cggaggacagccggaccgagccaacgccggggactttgttccctccacggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgaggggcctacggaggcgcaggagcggtggtgatggtctgggaagcggagctgaagtcccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagtaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcacctaagcaaaagattgtgaagcctgtgaaagtttcagctccccgagttggtggaaaacgctaaactggcagattagatttttaaataaagattggattat

SEQ ID NO: 449861 - DNA, 3798 bp, Homo sapiens
acagccagagaaacacaccgagacgtgctctttgtccacctggcttgcttctcacacctgctatgcttgtttctgcctcagacccacggaattggcgtatggaacacacacagctctccttttcagagaaaagaaactaatgcatttttctccaacaggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcatta

SEQ ID NO: 449862 - DNA, 6236 bp, Homo sapiens
cggaggacagccggaccgagccaacgccggggactttgttccctccacggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgaggggcctacggaggcgcaggagcggtggtgatggtctgggaagcggagctgaagtcccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagtaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcattaaaaaaaaaaaaaaaaaaaaaaaaaaaaaaaaaaaaaaaacaaaaaaaaaaaaacaacagaaaaaaccccggcgaggggccgcgtgggaggcggcgcaaaagaacatctacagcaacccgggggtgacggcgggggacaaagtgacgcaacacaggcggcgacgagagggtcgacacaggagaggacaacggagacaaaaaaaatagggagacgagcccgccaagatagcaaaagcgcgaggagacacacgggggcgtgagacaaaacccaggagagaactaccagggacaaacgagggaatataaaagagggaacaaagacagacggagcaaatgcg

SEQ ID NO: 449863 - DNA, 2527 bp, Homo sapiens
cggaggacagccggaccgagccaacgccggggactttgttccctccacggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgaggggcctacggaggcgcaggagcggtggtgatggtctgggaagcggagctgaagtcccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagtaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacgtgatctctaaaactgcaacagaacagcccctacatgtcccttttctccccagtggcaggggaacagtgacagcttctgcctctcaggggtgacttcaaggactgaggcttgcagagagcactgagagctgggtcgagcacatattatgaggtggtgttcaataaatacttgctgtcatcgtgtatgttcatggtgtagatacagaaacaaatttattcagtgtgaaactgcagcctatgaaaaatctctaaataaaaagcaagcataa

SEQ ID NO: 449864 - DNA, 1992 bp, Homo sapiens
cctagctgggatattggagcagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggagatcatcgggacaactctccttttgatggacctggaggaaatcttgctcatgcttttcaaccaggcccaggtattggaggggatgctcattttgatgaagatgaaaggtggaccaacaatttcagagagtacaacttacatcgtgttgcggctcatgaactcggccattctcttggactctcccattctactgatatcggggctttgatgtaccctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgttttataaaaaaaaaa

SEQ ID NO: 449865 - DNA, 4113 bp, Homo sapiens
agcgggctcttcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcaccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggcaaaaaaaaaaaa

SEQ ID NO: 449866 - DNA, 4331 bp, Homo sapiens
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggcaaaaaaaaaaaa

SEQ ID NO: 449867 - DNA, 1936 bp, Homo sapiens
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgctgcctgcatgcagctgatgaggacgcttgtgtgaggatgggagtggggtgggaatggataatgggaaagaatggagagctataaaaatgtgggggaggacattggaaaggggagatgaaagtccctttgtcctccatcacctgcctcaaacttcctcttgcagtccccggtatcctctgtaggttgggggcttccttcctttaccttttaaaaaaatcttcctgctcccgattcttagacctcacgttttctcttttcctttatgaatctcacctctctcaccttcttcaggtttaaatactccaattttccctttctctaaacttagaaatttccatgcatcaccctcttctagaattcatccctcaccattccttatataattgatttattgtaaagactcagaaataaatcaaacattctactaagaaaaattgagaaggggagctctgggggtggaaacatattagggtaaaagacttaaaattggaggcagcattatcagaagatgaagaacaactcagggatggggtgggaagaagacaggtccttttctgtacttcctagacaacctccattattccctaagggaatcagtgttgtgtctgtctacttttttttttttttttttgccacgtaattttacaaactctcccttttctaggcacccgaactctctgccatcttctctcctgggatgcagtcatcccatttgtatgcctcatacttcctctaccctggtagattctttcaagatccttgggctttactttcctcacataactcagttattctgcttctagtttaccattttattctggaaattgagagtcccatccaggggtggacttatgacactactgaaacttagacttcaaggttcctcacctacagggccctcttcctgtgctctaataatatagagggctcgatggatatgtgttcatatggtaacaggcttttgtaaaaattgcagaaataagattttaacagcaattgcttaaagccaattgtatgtgtaattttttttcttaaagactcccaattttgtaatattcaggcaccacagaaccaagatctgccccaaacttagctattggcattcccgtctcaaattctgttgtcctatgaaa

SEQ ID NO: 449868 - DNA, 488 bp, Homo sapiens
cattgagggtctcataggaaaacagttggaagccagagactgagaagcgttgaggagaggaggggaggctggcaaccatctttcttgtgaccttgtttctgccctagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtgagcactgaccccatggcattgaccctgtaggctgaccacagcagcccagatatagaggactaggaagaatcaatgctagatctgggatcggttgcttagaagtcttaaaaagtttgttaattcttcaggtctataaagcactttacagtttaaaaa

SEQ ID NO: 449869 - DNA, 5113 bp, Homo sapiens
  misc_feature (4529)..(4529): n is a, c, g, or t
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgaaaaaaaaaaaaaaaaaaaaanaaaaaaaaaaaaaaaaaaaaaaaaaaaaaaaaaaaaaaaaaaaaaaaaaaaaagagagagagggagggcggcgcggcacaacaagagatcatcctcctcgcggagagggcgccaccagcatgtgcgcggcggacccccgcggtgtttgttgtaagacagaaggggggcgccccagaaggaagaggagagtctatatatatcagacgagagacgcgcgagccgggggccctgtgtttaaaaaacgacgcgcgggagcggtgggagaacaaacggcgcgccacgacggcgcgaagaccctatcgtgggagggagacgaccacacactatacggggggggggggagaaaacaactcagggggagaacaaccatcacccctacaggagaagaattattaaagagacccctgtagaggggagagataataaatcaacacctcctaacgagagggtagtaataatgtgggtggtgcgaacacacaaggggggggtaaattccgccgcggcgcgctgagaaagaagagtctggggcgcccacgccgggggtactctgtattagctgagaaagaattcttttacccgcgggg

SEQ ID NO: 449870 - DNA, 3818 bp, Homo sapiens
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttgctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtg

SEQ ID NO: 449871 - DNA, 1909 bp, Homo sapiens
gctcaagtgactctctcctgccatcctaggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtg

SEQ ID NO: 449872 - DNA, 1913 bp, Homo sapiens
tttctcaatctatatttgaggatgatcctgaatttggatccttttcaaagggaaagttcaccaggaaactgtctgcatagactccctcccatgggaagtaaactctggatcttgtctgagcctgcagacctgagactccctcaatgtgtctttccctctaggtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtg

SEQ ID NO: 449873 - DNA, 3217 bp, Homo sapiens
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccacagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtg

SEQ ID NO: 449874 - DNA, 2304 bp, Homo sapiens
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagtttcctttcgtctgccaggtgaggaggtggtgggcaaattccttacaggatgtgactctcccacccgtctcaggagcaccttccatgatttatgattctctgcccttcctcctcagctttccctgactcttgtccctgttctttccttctagcatcacccctctg

SEQ ID NO: 449875 - DNA, 487 bp, Homo sapiens
tgggggtcccccccacaatggtaccccgtggtggcccttttctttcccccttaaaattcggggggttttcttcgggaaggagcccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtg

SEQ ID NO: 449876 - DNA, 410 bp, Homo sapiens
agacacagctaatacctactctagtctagtagcttccgatctaaggcagacacatgggtatagttaaagattttgaatgtacatgtgtccaatctgacaacagtaacacaaaccatccattcaagtagaagtgattgagtcagaattggattgcaccccttcccccacacccacacacatttcagttctttcctcatgattttttcctcccaagacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccg

SEQ ID NO: 449877 - DNA, 351 bp, Homo sapiens
cacagaccacgccctactctccccttcctcccactggggagcctgccttttcctctttcccaccattcctctctgtatgcctccccgactcaccccttaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtggagtagcctcggaagcccctcccctcttcaagactattccttttcct

SEQ ID NO: 449878 - DNA, 436 bp, Homo sapiens
ttcttgttctgttttgatttctccttttaatttattctgtccacttaccctacgtcctccccctacatttttctgtgcccttcctctctttccctgtgcccttcctctctttccctcctccccactccttcatcacctcctcttctcctactatcccaattgtgcttcttcctccagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccat

SEQ ID NO: 449879 - DNA, 399 bp, Homo sapiens
aagaaaacggtaattaatgatgaaagtgagtaattgagaaaggaactaatttgttcgagaaagataagagcaggaattgcagacaggggaggggccccaggagagcttgccctcatctcctcttgtctttcagtgtgatccaggccaagccaccaagtacctatatgagctgctctacaacgaccctatcaagatcatccttatgcctggctgcagctctgtctccacgctggtggctgaggctgctaggatgtggaacctcattgtggtaagcagggctatgggggtcagaagatggggtcattcccttttgagctctactgaagggacgatggcgattgtgggtttgtattgaaaaggagtgtggaggacctgctactaagattcagagtcctctgc

SEQ ID NO: 449880 - DNA, 4528 bp, Homo sapiens
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggcaaaaaaaaaaaa

SEQ ID NO: 449881 - DNA, 4377 bp, Homo sapiens
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggcaaaaaaaaaaaa

SEQ ID NO: 449882 - DNA, 4507 bp, Homo sapiens
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtg

SEQ ID NO: 449883 - DNA, 4290 bp, Homo sapiens
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgcttcgcaacactgttgcgaggaatgctgagagtgatggtttccggttacatccatgtccctacaaaggacatgaactcatcattaat

SEQ ID NO: 449884 - DNA, 2081 bp, Homo sapiens
cattgagggtctcataggaaaacagttggaagccagagactgagaagcgttgaggagaggaggggaggctggcaaccatctttcttgtgaccttgtttctgccctagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtg

SEQ ID NO: 449885 - DNA, 4008 bp, Homo sapiens
  misc_feature (3424)..(3424): n is a, c, g, or t
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcaaaaaaaaaaaaaaaaaaaaanaaaaaaaaaaaaaaaaaaaaaaaaaaaaaaaaaaaaaaaaaaaaaaaaaaaaagagagagagggagggcggcgcggcacaacaagagatcatcctcctcgcggagagggcgccaccagcatgtgcgcggcggacccccgcggtgtttgttgtaagacagaaggggggcgccccagaaggaagaggagagtctatatatatcagacgagagacgcgcgagccgggggccctgtgtttaaaaaacgacgcgcgggagcggtgggagaacaaacggcgcgccacgacggcgcgaagaccctatcgtgggagggagacgaccacacactatacggggggggggggagaaaacaactcagggggagaacaaccatcacccctacaggagaagaattattaaagagacccctgtagaggggagagataataaatcaacacctcctaacgagagggtagtaataatgtgggtggtgcgaacacacaaggggggggtaaattccgccgcggcgcgctgagaaagaagagtctggggcgcccacgccgggggtactctgtattagctgagaaagaattcttttacccgcgggg

SEQ ID NO: 449886 - DNA, 2763 bp, Homo sapiens
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtgagcactgaccccatggcattgaccctgtaggctgaccacagcagcccagatatagaggactaggaagaatcaatgctagatctgggatcggttgcttagaagtcttaaaaagtttgttaattcttcaggtctataaagcactttacagtttaaaaa

SEQ ID NO: 449887 - DNA, 986 bp, Homo sapiens
agcggcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtggagtagcctcggaagcccctcccctcttcaagactattccttttcctgccgcaaacttagcattactgcttgcaagtcagcactttaaatccagtataccaaaattcacaaatacatttattgaatgactactacataagagcaattttgctctgtgcggttggaggtagtagagctagcagcctgcacagttcatttcatcctcccttcattaggccactgatcattggcctataacattgataattcatcttgtcagttattctctttgaggatcattagtggcagatgatgacaaaaaaattctaaaatgatttcatcacatttttgaatacctctgtcaccaacccagagaccatatgcccaagaaacaaaagccag

SEQ ID NO: 449888 - DNA, 1671 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggtgggtgtcgcggcggggcttgaggctctgacggccaaggaggacggagccgccgcgggggccatgagccaggtgtcgccggccgcccagcgtctgtagcgagggttgccgcagggcccgcggacctcctagcgacggctgggaccggcaggacggtaagcaaagcggctcccgggctcacacccaagcttgccgctgccgccgctcggtgcagtgcggcgcgtagcc

SEQ ID NO: 449889 - DNA, 886 bp, Homo sapiens
aatgaaggggaaagactaactgtctaacccaattgaaaatcaaatgatgaccaaacttcaattgtagtatttgtgctgattgcttggatactgtttcttcagaaactatgctcaagtcacagtttgtacctaaccacatcctaccaccacatcctgctgggctaaaatcccaaaaagtaataagagacgcattcaactttatgagaggaaagcaaaacctaatctttcaggtggtgaggtccacccagtatggagctcaaaggtgccattgttctgctcatgtttataaagggagctgccatgtttctctgaacgcagagttgggagcaactccagagcctccttcaagatgctgctggtcctgctctcagtggtccttctggctctgagctcagctcagagcacagataatgatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449890 - DNA, 2637 bp, Homo sapiens
  misc_feature (595)..(595): n is a, c, g, or t
  misc_feature (1312)..(1312): n is a, c, g, or t
  misc_feature (1519)..(1519): n is a, c, g, or t
  misc_feature (2028)..(2028): n is a, c, g, or t
  misc_feature (2035)..(2035): n is a, c, g, or t
  misc_feature (2065)..(2065): n is a, c, g, or t
  misc_feature (2074)..(2074): n is a, c, g, or t
  misc_feature (2161)..(2161): n is a, c, g, or t
  misc_feature (2175)..(2175): n is a, c, g, or t
  misc_feature (2191)..(2191): n is a, c, g, or t
  misc_feature (2207)..(2207): n is a, c, g, or t
  misc_feature (2210)..(2210): n is a, c, g, or t
  misc_feature (2215)..(2215): n is a, c, g, or t
  misc_feature (2260)..(2260): n is a, c, g, or t
  misc_feature (2263)..(2263): n is a, c, g, or t
tgcactccagcctgggagacaacgagactccgtctcaaaaacaacaacaacaacaacaaaaaaaacaaaaaccgcataaaatttaaataatggaatagaatgatggagctgtggttgagattctatatgtaattaatgacattttgagatccagtgctgctcattgaatttccctgtgaaaagagtttgtggtgatgacccagcaacagataagctactatccaaaaaaagctattgacatgaaatcaatttccagttttttccgagtttcatgaggctgcctagatcctgcttttactctcttctttgaccaaagtattacaaaaataaaaatatcattaccattttcatgtcaggtatactaaaagtttaaaaaaactttttttaataacttgattttaggaatattggtttagtttctccgttagaaaacgatttatataaggagaacaaaaagttcatttctacctctaaaacaataagacaaaaaaaagggtcatcaattttgagaatccaatagcgttaacaaccagttaaacataagaaagaattagtgaattggaagataactacccagaatgaagcataaagagancaagaggtagaaaatataaggctagagggccacagacagtgaagctacaatcagaacaactaacatacttctgcagttccagaagattagaagagagcaaatggggcagaagcaatgtggagatttttccaaaagtgataaagtatatcagttcatatatttttagaaactatcagacttcagacacgataactaaaaccaaattaacataaaatgacaggacatcaaagaccaatagaaaacctgaaaagtaactagaggaaaagatagattatgttaaagggaataactgtctaaacgacaagctgattttcaacagacaaaaataaagctagagttcaatggattcatgtcttcagtgtatttcaaaagtagaatagatcttgataaacagaaatttaaaatatatcttttcagataaaagaaaaattattattattattatttttgttggtagagttggattctcactctgttgtccacgctggagttcagtggtaggatcatggcttactgcagtctggaactcctgggctcaaaccatcctcccacctcagccttgtgagtagcttcactatgcctgactaactttttcattcattgtagaggcagttttgctgtgttgcacaggctggtcttgaactcctgggtgctcctgccccagccttacaaaatgttgggattatgggtgtgagctaccctgcctggccaataaanggtcttattgaaaatattaagttgaatatgcaagaaggaatacaaattaatgaaagtggtaaatatgtgcataattctaaatgaatgtttagaaaataataatgtcttgttggggtaattatacaattgataagacatgcaaatggcaaaaaatagaatggaggtaaaggtgacaggagtaagtttagttaaattattttctgaacntttctatgtctatgaggagattttgaacaatgataatataattctactcataggtatatatgcaaaggaattgtatcaaatgatatatgaaagaatgttctagtagaattattcataactgttcaaaaaagaaactggccaaatacatattaaggttggatgaatcattacagtaattccatgcaatggaacaatatagagaagtgaaaaaaaatcacatgtgcttgcaactatgtgactaaatttcagaaacataatgttgagttcaggaagccacaaacaagaggaacatgtaggattgcacctatacagcgttcaaagtaggctagaccaagcgatggagtttagggttgcatacctagttggtaaagtatgaagaaaattgaggaaataaccattataaattatggatattgcttatatcaggagatgcgaagaagggtttagggacttggaaagtggaatggaggtggatctagcctgttttaggtgttccttgtcttgccctncatcatngttacttgagtgtttatgatacactgtggnatttcccanttttgtattggttcatttctaagtgcgcattataactttaatatacaaatttgtaattaggagaaatatagaaattattattactcntctcattatatacngaagggaaatatcaantatttgtatacattcntanacaantctaagatagttgaaataggaactttcttatttagttgcaacatnagnaaatttgagatgatgttatctgccacccccagatctttccaaaggatttcttctagccttaattatcgacctcacaggacaaacctttgccattccccatctattttttctttcggctcctgaattcctgacacaacaaggttgtacatatttcccacactcttggtttaagagttcttttatcagttatgtttctctgcaggagaagacccttcaaaactacattagatatttatatctcacatgtcgtttgatgttggttttttgttttgttttgttttgttttgttttgttttgttttttgacagagtcttgctgtgtcgcccaggctggagtgcagtggcataatctcagttcactgcaacctccgcctc

SEQ ID NO: 449891 - DNA, 654 bp, Homo sapiens
aatgaaggggaaagactaactgtctaacccaattgaaaatcaaatgatgaccaaacttcaattgtagtatttgtgctgattgcttggatactgtttcttcagaaactatgctcaagtcacagtttgtacctaaccacatcctaccaccacatcctgctgggctaaaatcccaaaaagtaataagagacgcattcaactttatgagaggaaagcaaaacctaatctttcaggtggtgaggtccacccagtatggagctcaaaggtgccattgttctgctcatgtttataaagggagctgccatgtttctctgaacgcagagttgggagcaactccagagcctccttcaagatgctgctggtcctgctctcagtggtccttctggctctgagctcagctcagagcacagataatgatgtgaactatgaagactttactttcaccataccagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449892 - DNA, 1431 bp, Homo sapiens
gaggtgttcgaagccgggtggtgcgtgggctaccccaacctgtgtggctgggccgcgggctcccctcaagggcctggggccgtgcctcgggtgtacgcgtaggggtctgtgtgctgggggtggctcaccgggcagcgtgggtgagcggcgcagcggcggcagcggagagcgagagaggggagcagctgctgcagaagaatattttgcctgctggaacctgctgtatctactcaagagtggaagttttcacagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttgaatatattagaaaaaaaatagctcctaagaaattcttgtatgttatataaactttatacttccttaagattctttcattgtgtataactttgtgaattttacaaagatatgcttggaatcaacaccatccaaacatatcacaaattaggatatatgaaagtatgtatattaccatacagagaagaatgcgaatactataaagagttcttatacaaacagataatatagattttgtatcaatcattcaccttttttgagatttttaaatgagaaaacctataatgtataaaatacatgtgtgtatgtatgtatgtgacacagttactaaaaataggcttcttaaacttacatctcaatctggtagataaagtacataaaagaatatggaattttagtacctatattaagtgtttttaatttttgtataatatttagtacctgattagcgtgtatgcaaaaaagtaatttgcttcgtttgttgaattagaagccagctgccttactaaactaccacatttgctttgctcattctcttggctttgcagatagaaaattatatcatctgcatatagtgacttataatgattattttacttctccattttactacttgtaattcttttttggtatcagttgtataatgaaatggtttgaacattcaaagtgttaagtaatcctgatcgtaactgctgtctttgcaaatggagtgttttctagtgttttaacaataaacgtaatactgactctagctttgagataaattcttttaaaaatattattcagggagaatatttgtttcctatcttcctgtgtatagtattgtaataaaatctctgttaaaaactatcaaaaaaaa

SEQ ID NO: 449893 - DNA, 484 bp, Homo sapiens
attgtttggttgttccgtaatctatttaaccaatccctgtcactggatattaaggctggattcacattctcactattatatgatatgttgcagtgcccatctttgtaaaaatagcccttacataaccaacagcagcaaagcatgaacacataacaataattgtttctctttctcatctaagcaacactttaaatcacattatgtgcaatggcttaaagagtgaacaaagaaaatattactaaggagaagggggctgtagaagggatagagggcaagagtaggggcttgcatctccatcactgcagtaacccccagtgagggattagacatttcctgccatgtcaagtgttgtctgtaatcttccttgtttgcttgtctttttcaggaagtgaataagaagataacagtgtttcaaatgccgtgaaacatggcatcatgctctaacttcagtataccaataaaacaatcagcttgcaaaaatctg

SEQ ID NO: 449894 - DNA, 1040 bp, Homo sapiens
aatgaaggggaaagactaactgtctaacccaattgaaaatcaaatgatgaccaaacttcaattgtagtatttgtgctgattgcttggatactgtttcttcagaaactatgctcaagtcacagtttgtacctaaccacatcctaccaccacatcctgctgggctaaaatcccaaaaagtaataagagacgcattcaactttatgagaggaaagcaaaacctaatctttcaggtggtgaggtccacccagtatggagctcaaaggtgccattgttctgctcatgtttataaagggagctgccatgtttctctgaacgcagagttgggagcaactccagagcctccttcaagatgctgctggtcctgctctcagtggtccttctggctctgagctcagctcagagcacagataatggtaaaaaaattatttttttaaaaaaggagatggggagtgggatgaggggccatgactcttctagggcctcaggggttcaccctacaccactgcagcggaagagcaggaggggaggaaggaggttgagaagaagggtagggctttggagctctcattccaaggatgacatctgttgtgccctcattccatgccaaggccttatactttatttgatatacacttggaacccaatagagaatttcaattagaggaatgacaaagtaagatttgtatttttagaaagacctggctgtgctgtgaaggatgcagtggagaatgcaagactgatccagggaagtccagctatgaagatgctacagtaatctcagtggacagcgatgatggtgtccttgctgtacaggggatgcagaatcaatgaaagagataaacaaacatcagagtactgtcagacatagaggactggataatacatttgtgtctttctacatagtggtatagaaatatcaggtccccaaattcccatttttcttccaatcacatttaaaatttcaatatgttgcaggcagcatgtgtaagattatatccaaatatttactcctggttgctcctcttgggcaagcttgtgaa

SEQ ID NO: 449895 - DNA, 404 bp, Homo sapiens
gcgtcgatctgaggatcccctatgtgtcgccggccgcccagcgtctgtagcgagggttgccgcagggcccgcggacctcctagcgacggctgggaccggcaggacggggaagtccaggaaactcacttgctctgggctgcatgctggctaaacagaaaggatctgccagtgaaggaaggcagaaaacccaccaatcctggactctgcatgaacaccaggaaaaacccatttgctgcaggaagggggcagttaacctgatgatatcaagaccctccactgatacaagacattgattgactgacactcaaggaggggcaggaagattgcctgacttggactcccatgctgacactgggtgaaagccatctgttgctactggaggagggggagaaaaccggctttca

SEQ ID NO: 449896 - DNA, 183 bp, Homo sapiens
actactacaggttcaagttgcagtcattttcataaatataaccttgaatgttttgaacagtaaccaaaacataaacaccataaaaaaatctgttttcttaatcttgaaagcaataatttacttcagtaatatcatcaaggaattagataagttttgccatgttgtatgttgtgtataaatttc

SEQ ID NO: 449897 - DNA, 2152 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacagatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449898 - DNA, 2323 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgagtttctccagcatttggctctaggtgccaagggcacatgtgacaagaaggtgccagctttataaaccttggaacttcttctgtgtcagttctgagacatacagtttactaaaacacatcatgaaggcctgttttgaagagaaggggaataagactgcatctgttcatatgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacagatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449899 - DNA, 2307 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggtgggtgtcgcggcggggcttgaggctctgacggccaaggaggacggagccgccgcgggggccatgagccaggtgtcgccggccgcccagcgtctgtagcgagggttgccgcagggcccgcggacctcctagcgacggctgggaccggcaggacggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacagatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449900 - DNA, 2256 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagagttggagtctcactctgttatccaggctggagttcagtggtaggatcatggcttactgcagtctggaactcctgggctcaaaccatcctcccacctcagccttctgctgcagaagaatattttgcctgctggaacctgctgtatctactcaagagtggaagttttcacagatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449901 - DNA, 613 bp, Homo sapiens
aattcgtggtgctgctctgggtgctgctgtggtgctgctcggcgaattcgtggtgctgctcggcgaattcgtggtgatgctgctggtcctgctctcagtggtccttctggctctgagctcagctcagagcacagataatgatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449902 - DNA, 2464 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagagttggagtctcactctgttatccaggctggagttcagtggtaggatcatggcttactgcagtctggaactcctgggctcaaaccatcctcccacctcagccttctgctgcagaagaatattttgcctgctggaacctgctgtatctactcaagagtggaagttttcacagtaaagggagctgacacgtttctcccagcacaaagttgggagtgacaccagagcctcctgcaagatgcttctgattctgctgtcagtggccctgctggccttcagctcagctcaggatttaaatgaagatgtcagccaggaagatgttcccctcgtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagataacagtgtttcaaatgccgtgaaacatggcatcatgctctaacttcagtataccaataaaacaatcagcttgcaaaaatctg

SEQ ID NO: 449903 - DNA, 2536 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagagttggagtctcactctgttatccaggctggagttcagtggtaggatcatggcttactgcagtctggaactcctgggctcaaaccatcctcccacctcagccttctgctgcagaagaatattttgcctgctggaacctgctgtatctactcaagagtggaagttttcacagtaaagggagctgacacgtttctcccagcacaaagttgggagtgacaccagagcctcctgcaagatgcttctgattctgctgtcagtggccctgctggccttcagctcagctcaggatttaaatgaagatgtcagccaggaagatgttcccctcgtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449904 - DNA, 1780 bp, Homo sapiens
gcggcgctggttgtgtgggttgtgggggggtggtgagggtggagttgggggggtggtgtggtgtgtggttgttggtgtgtgctacgatctccgtcgagtggtggacgggttgttgttttatgtggtgttggtgtgtggagtagatgataggtaggtgggggctcctgccccgccccgctgtggtagtgagtgggtggtctcctcccgcgcggcgttgtttgggtgtgtgtggggcccaccgccacgggtgttgtgtttgtgtgtgcgcccgcgcgggggggggaccgccccccccccaacaaaaaaaaaaagggggggggggtgaaaaaaaagggggttttgttgtgccccccgcaaaaaaaaagggcctttgcagcattttatggcgtctggggggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacagatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449905 - DNA, 2567 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacagatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcaggtatgattccagttcattctccattaaatgcccaaactgctaccattcccaaactttatcgtgttcacaaatcaattggaaatatgttgaaattacataatcctggaccccatttctaaagatttgtattcagatattcttggataaggttgcaagtccttgtatttttaacaagtggttcaaagaattcttatcttttgaaatactgacctccccaacttttttcttaagatgacttgtctcattaaaatgagttggtaatgaggaagtggggtgtgctctccctttggtgctctgcctcctgtctttgagtctgccttctcaaacccaaggactctccatctcaggtttctctcaggtttccgccagaggactctttgctcagtcctgcctcacactagcctctcaggtccagtgtccctgctaaatgatacttgaacttgatgctcttatatcttatttaatttttaaaatacttattttgaaattagtacatgctcaaggaaaaaaaaatctaactgaacagaat

SEQ ID NO: 449906 - DNA, 2962 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagagttggagtctcactctgttatccaggctggagttcagtggtaggatcatggcttactgcagtctggaactcctgggctcaaaccatcctcccacctcagccttctgctgcagaagaatattttgcctgctggaacctgctgtatctactcaagagtggaagttttcacagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttgaatatattagaaaaaaaatagctcctaagaaattcttgtatgttatataaactttatacttccttaagattctttcattgtgtataactttgtgaattttacaaagatatgcttggaatcaacaccatccaaacatatcacaaattaggatatatgaaagtatgtatattaccatacagagaagaatgcgaatactataaagagttcttatacaaacagataatatagattttgtatcaatcattcaccttttttgagatttttaaatgagaaaacctataatgtataaaatacatgtgtgtatgtatgtatgtgacacagttactaaaaataggcttcttaaacttacatctcaatctggtagataaagtacataaaagaatatggaattttagtacctatattaagtgtttttaatttttgtataatatttagtacctgattagcgtgtatgcaaaaaagtaatttgcttcgtttgttgaattagaagccagctgccttactaaactaccacatttgctttgctcattctcttggctttgcagatagaaaattatatcatctgcatatagtgacttataatgattattttacttctccattttactacttgtaattcttttttggtatcagttgtataatgaaatggtttgaacattcaaagtgttaagtaatcctgatcgtaactgctgtctttgcaaatggagtgttttctagtgttttaacaataaacgtaatactgactctagctttgagataaattcttttaaaaatattattcagggagaatatttgtttcctatcttcctgtgtatagtattgtaataaaatctctgttaaaaactatcaaaaaaaa

SEQ ID NO: 449907 - DNA, 2238 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagagttggagtctcactctgttatccaggctggagttcagtggtaggatcatggcttactgcagtctggaactcctgggctcaaaccatcctcccacctcagccttctgctgcagaagaatattttgcctgctggaacctgctgtatctactcaagagtggaagttttcacagtaaagggagctgacacgtttctcccagcacaaagttgggagtgacaccagagcctcctgcaagatgcttctgattctgctgtcagtggccctgctggccttcagctcagctcaggatttaaatgaagatgtcagccaggaagatgttcccctcgtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggggtgctgacgttggaccgag

SEQ ID NO: 449908 - DNA, 2858 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttgaatatattagaaaaaaaatagctcctaagaaattcttgtatgttatataaactttatacttccttaagattctttcattgtgtataactttgtgaattttacaaagatatgcttggaatcaacaccatccaaacatatcacaaattaggatatatgaaagtatgtatattaccatacagagaagaatgcgaatactataaagagttcttatacaaacagataatatagattttgtatcaatcattcaccttttttgagatttttaaatgagaaaacctataatgtataaaatacatgtgtgtatgtatgtatgtgacacagttactaaaaataggcttcttaaacttacatctcaatctggtagataaagtacataaaagaatatggaattttagtacctatattaagtgtttttaatttttgtataatatttagtacctgattagcgtgtatgcaaaaaagtaatttgcttcgtttgttgaattagaagccagctgccttactaaactaccacatttgctttgctcattctcttggctttgcagatagaaaattatatcatctgcatatagtgacttataatgattattttacttctccattttactacttgtaattcttttttggtatcagttgtataatgaaatggtttgaacattcaaagtgttaagtaatcctgatcgtaactgctgtctttgcaaatggagtgttttctagtgttttaacaataaacgtaatactgactctagctttgagataaattcttttaaaaatattattcagggagaatatttgtttcctatcttcctgtgtatagtattgtaataaaatctctgttaaaaactatcaaaaaaaa

SEQ ID NO: 449909 - DNA, 2024 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagagttggagtctcactctgttatccaggctggagttcagtggtaggatcatggcttactgcagtctggaactcctgggctcaaaccatcctcccacctcagccttctgctgcagaagaatattttgcctgctggaacctgctgtatctactcaagagtggaagttttcacagatgtgaactatgaagactttactttcaccataccagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449910 - DNA, 2689 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgagctgctgcagaagaatattttgcctgctggaacctgctgtatctactcaagagtggaagttttcacagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttgaatatattagaaaaaaaatagctcctaagaaattcttgtatgttatataaactttatacttccttaagattctttcattgtgtataactttgtgaattttacaaagatatgcttggaatcaacaccatccaaacatatcacaaattaggatatatgaaagtatgtatattaccatacagagaagaatgcgaatactataaagagttcttatacaaacagataatatagattttgtatcaatcattcaccttttttgagatttttaaatgagaaaacctataatgtataaaatacatgtgtgtatgtatgtatgtgacacagttactaaaaataggcttcttaaacttacatctcaatctggtagataaagtacataaaagaatatggaattttagtacctatattaagtgtttttaatttttgtataatatttagtacctgattagcgtgtatgcaaaaaagtaatttgcttcgtttgttgaattagaagccagctgccttactaaactaccacatttgctttgctcattctcttggctttgcagatagaaaattatatcatctgcatatagtgacttataatgattattttacttctccattttactacttgtaattcttttttggtatcagttgtataatgaaatggtttgaacattcaaagtgttaagtaatcctgatcgtaactgctgtctttgcaaatggagtgttttctagtgttttaacaataaacgtaatactgactctagctttgagataaattcttttaaaaatattattcagggagaatatttgtttcctatcttcctgtgtatagtattgtaataaaatctctgttaaaaactatcaaaaaaaa

SEQ ID NO: 449911 - DNA, 2256 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagagttggagtctcactctgttatccaggctggagttcagtggtaggatcatggcttactgcagtctggaactcctgggctcaaaccatcctcccacctcagccttctgctgcagaagaatattttgcctgctggaacctgctgtatctactcaagagtggaagttttcacagagatatttgcttacattccagtgtaaagcttcttcttcagaaggcaagatggacaggttactcacagtgatcaaagtttttaagactggagtttcctaattttgagatttctcttttgatagacaccactacttgcacatgtaacatcagtttctcatcttatccctgtgaggggactgaagcttgaagaaatagtacgatgatattcctctgactactgctagtacttcagtgaataataaaccatcttttgccttctgcaagtacaacaagtgacaagctaagttgttagcttataataattttggcaacgaggatggaacacagcccaaagacctggccttctgaggagaaagtgaaggatcctacaagctgattaataggatttgctgaaagtccatgggaactggtagctaacatgttgactaaaatgtttgtaattggtaaataaatattcttctattaaaagctca

SEQ ID NO: 449912 - DNA, 2411 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggtgggtgtcgcggcggggcttgaggctctgacggccaaggaggacggagccgccgcgggggccatgagccaggtgtcgccggccgcccagcgtctgtagcgagggttgccgcagggcccgcggacctcctagcgacggctgggaccggcaggacggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagagttggagtctcactctgttatccaggctggagttcagtggtaggatcatggcttactgcagtctggaactcctgggctcaaaccatcctcccacctcagccttctgctgcagaagaatattttgcctgctggaacctgctgtatctactcaagagtggaagttttcacagagatatttgcttacattccagtgtaaagcttcttcttcagaaggcaagatggacaggttactcacagtgatcaaagtttttaagactggagtttcctaattttgagatttctcttttgatagacaccactacttgcacatgtaacatcagtttctcatcttatccctgtgaggggactgaagcttgaagaaatagtacgatgatattcctctgactactgctagtacttcagtgaataataaaccatcttttgccttctgcaagtacaacaagtgacaagctaagttgttagcttataataattttggcaacgaggatggaacacagcccaaagacctggccttctgaggagaaagtgaaggatcctacaagctgattaataggatttgctgaaagtccatgggaactggtagctaacatgttgactaaaatgtttgtaattggtaaataaatattcttctattaaaagctca

SEQ ID NO: 449913 - DNA, 2056 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacaggtaacttctacatatcaagtaacacaggatcaaatgaaaacctagcaacacttggtttctgcctgtatcagacaggtgaaattgcaagcagttatacaagtagtgtactaacttctcataaagcctactcaaggagggtattgttattgtgtgcgttttacagatggctatcctaaggctgatagtagttgtaaaatatagtctaagttcatatctatatgaaacagagtatctgggtttctgtcctggccatcagacttgaagatcatttcttagaaacaattatattatcaaaactgaaaagaaatacaatccaaggttggagtcttattttagcatctattaatcttaagccattaagtaatcaaaaataaatt

SEQ ID NO: 449914 - DNA, 1716 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacagaagatgcagttccatggcaaaggatctccagattcca

SEQ ID NO: 449915 - DNA, 1661 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgaggtgttgctctgtctccccgttggagtgcagtggtgtgatctcgaccaaa

SEQ ID NO: 449916 - DNA, 671 bp, Homo sapiens
gttgatgctcagcgatagtaacaatcctgcctcccctaacatcttcctccccttccagcagcttcacagaacatggttgatgaggtaacttaggggatgcacagggtgtggccagaagacccctttccctatagaccactatgagccctgaaagatttatgaggtaatgttcacttcatcctgtgcttcttttcctagatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449917 - DNA, 2179 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgagtttctccagcatttggctctaggtgccaagggcacatgtgacaagaaggtgccagctttataaaccttggaacttcttctgtgtcagttctgagacatacagtttactaaaacacatcatgaaggcctgttttgaagagaaggggaataagactgcatctgttcatatgagagttggattctcactctgttgtccacgctggagttcagtggtaggatcatggcttactgcagtctggaactcctgggctcaaaccatcctcccacctcagccttgttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagttttgtggcagatgacacgctgagtgaaagaagagaaacctcatccatagattcaccaggggctcgtgggtcttctagcagaaaaaaactgatgctgtgcgaacaatattggcccgcggacctgcggttttctccgagcggcggtttccaggaactttcatttcaggtacccggtcctggaaacgacactgggttgccgttcacaggggaagcagcgctcaacaggtgcaatctccaaccccggggaggtgggggccaacaccagcgggcgagacaactccttcaaacagct

SEQ ID NO: 449918 - DNA, 1833 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgagtttctccagcatttggctctaggtgccaagggcacatgtgacaagaaggtgccagctttataaaccttggaacttcttctgtgtcagttctgagacatacagtttactaaaacacatcatgaaggcctgttttgaagagaaggggaataagactgcatctgttcatatgaggtatgtcgaagcacttggatatgttttcaaaccaccaatcttgatcatttagaaatgtgctcccttttccaatttcatcctgataaaaatgtatgatctctggacgttgccaatattcccctccattccatcatgagccgttctctgtaattcagaatctgtggactaagctgtaaaactaatgactgtcaatctattctacgtgaaatagtgggccaa

SEQ ID NO: 449919 - DNA, 1955 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgagtttctccagcatttggctctaggtgccaagggcacatgtgacaagaaggtgccagctttataaaccttggaacttcttctgtgtcagttctgagacatacagtttactaaaacacatcatgaaggcctgttttgaagagaaggggaataagactgcatctgttcatatgagacaggtaaaatggaaagcagttatacaaatgctatactaactcctcacaaagactacccaaagataatattatcatctgtgttttttggtgatcatactgaggcagagagcagttgtgaaatggagtctcagaatcgtcggtatatgaagcagaaaaactggtttcctctcttggcagtctgactccaagatctcttagaaacaattatactgtaaaaacctgaaaaagaagtaaaaaacaagaatggagactaatactaacatctattcttcttaatagcataatcaaaaataaattaaacagaaaaataaaagtgaatattcataccaagggaagtcta

SEQ ID NO: 449920 - DNA, 3199 bp, Homo sapiens
  misc_feature (39)..(39): n is a, c, g, or t
  misc_feature (76)..(76): n is a, c, g, or t
  misc_feature (1874)..(1874): n is a, c, g, or t
  misc_feature (2081)..(2081): n is a, c, g, or t
  misc_feature (2590)..(2590): n is a, c, g, or t
  misc_feature (2597)..(2597): n is a, c, g, or t
  misc_feature (2627)..(2627): n is a, c, g, or t
  misc_feature (2636)..(2636): n is a, c, g, or t
  misc_feature (2723)..(2723): n is a, c, g, or t
  misc_feature (2737)..(2737): n is a, c, g, or t
  misc_feature (2753)..(2753): n is a, c, g, or t
  misc_feature (2769)..(2769): n is a, c, g, or t
  misc_feature (2772)..(2772): n is a, c, g, or t
  misc_feature (2777)..(2777): n is a, c, g, or t
  misc_feature (2822)..(2822): n is a, c, g, or t
  misc_feature (2825)..(2825): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgagtttctccagcatttggctctaggtgccaagggcacatgtgacaagaaggtgccagctttataaaccttggaacttcttctgtgtcagttctgagacatacagtttactaaaacacatcatgaaggcctgttttgaagagaaggggaataagactgcatctgttcatatgagagttggattctcactctgttgtccacgctggagttcagtggtaggatcatggcttactgcagtctggaactcctgggctcaaaccatcctcccacctcagccttgtgagtagcttcactatgcctgactaactttttcattcattgtagaggcagttttgctgtgttgcacaggctggtcttgaactcctgggtgctcctgccccagccttacaaaatgttgggattatgggtgtgagctaccctgcctggccaataaanggtcttattgaaaatattaagttgaatatgcaagaaggaatacaaattaatgaaagtggtaaatatgtgcataattctaaatgaatgtttagaaaataataatgtcttgttggggtaattatacaattgataagacatgcaaatggcaaaaaatagaatggaggtaaaggtgacaggagtaagtttagttaaattattttctgaacntttctatgtctatgaggagattttgaacaatgataatataattctactcataggtatatatgcaaaggaattgtatcaaatgatatatgaaagaatgttctagtagaattattcataactgttcaaaaaagaaactggccaaatacatattaaggttggatgaatcattacagtaattccatgcaatggaacaatatagagaagtgaaaaaaaatcacatgtgcttgcaactatgtgactaaatttcagaaacataatgttgagttcaggaagccacaaacaagaggaacatgtaggattgcacctatacagcgttcaaagtaggctagaccaagcgatggagtttagggttgcatacctagttggtaaagtatgaagaaaattgaggaaataaccattataaattatggatattgcttatatcaggagatgcgaagaagggtttagggacttggaaagtggaatggaggtggatctagcctgttttaggtgttccttgtcttgccctncatcatngttacttgagtgtttatgatacactgtggnatttcccanttttgtattggttcatttctaagtgcgcattataactttaatatacaaatttgtaattaggagaaatatagaaattattattactcntctcattatatacngaagggaaatatcaantatttgtatacattcntanacaantctaagatagttgaaataggaactttcttatttagttgcaacatnagnaaatttgagatgatgttatctgccacccccagatctttccaaaggatttcttctagccttaattatcgacctcacaggacaaacctttgccattccccatctattttttctttcggctcctgaattcctgacacaacaaggttgtacatatttcccacactcttggtttaagagttcttttatcagttatgtttctctgcaggagaagacccttcaaaactacattagatatttatatctcacatgtcgtttgatgttggttttttgttttgttttgttttgttttgttttgttttgttttttgacagagtcttgctgtgtcgcccaggctggagtgcagtggcataatctcagttcactgcaacctccgcctc

SEQ ID NO: 449921 - DNA, 461 bp, Homo sapiens
tcttgtccattaattactcacacaatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449922 - DNA, 381 bp, Homo sapiens
aattcgtggtgctgctctgggtgctgctgtggtgctgctcggcgaattcgtggtgctgctcggcgaattcgtggtgatgctgctggtcctgctctcagtggtccttctggctctgagctcagctcagagcacagataatgatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaccgcatcatcccagccaccagttttacagcgtccacc

SEQ ID NO: 449923 - DNA, 646 bp, Homo sapiens
tagagagatcggacggggtgtagacgagtacggacgcgttcgatgaagcgaccgtgtgggtagcagcaatctcaaccctctgctggtgatgggaaccagaatgatggccctcagcagggaccaccccaacaaggaggccagcagcaacaaggtccaccacctcctcagggaaagccacaaggaccaccccaacagggaggccagtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449924 - DNA, 1194 bp, Homo sapiens
tagagagatcggacggggtgtagacgagtacggacgcgttcgatgaagcgaccgtgtgggtagcagcaatctcaaccctctgctggtgatgggaaccagaatgatggccctcagcagggaccaccccaacaaggaggccagcagcaacaaggtccaccacctcctcagggaaagccacaaggaccaccccaacagggaggccagtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggtacgattccagtttattatccatcaaaggctccaactgctacagttctccaacttcattgtgccaatgaatcctctgaaaacctgttaatattgccctgtcctggaacacatttctaaaaattgttattcagatattcttgtatagagtatcaagaccctgtgaccctgtgttttacagaagctcttgaaggcaattctgattttgagaatcactatcttcaaattacatgtcttaagtagggttgacaatgaggacatagaaccatgttccccctttggctctctctattttctttcctcaaactcagactcccatttaaagttttcacctgaacatgctttgctcagtcctgcctcacatcaggctttcaggtccagtattcctgctaagtggtccttgaactttcagttgtaaaatggtatctcatttttagtatacttacatttaaagtcatacatgcttaagctaacaaaaactaatctcactgaaccgaaatgtacagagctaaatagtaagagcctaactcatctttcctcccttctatccttctcaaaacccccaccttttactctttggaatctactttttgaaatatatattgctacataaatatatataatgcttttattacaagcacttataccatactgtatattcagatttgtgtcttactcactggaaaaatttattgtttagaaaactttctcatgagttca

SEQ ID NO: 449925 - DNA, 1809 bp, Homo sapiens
atgggtggtgtcataaagagcatatttacattcgttttaattgtggaatttataattggaaatttaggaaatagtttcatagcactggtgaactgtattgactgggtcaagggaagaaagatctcttcggttgatcggatcctcactgctttggcaatctctcgaattagcctggtttggttaatattcggaagctggtgtgtgtctgtgtttttcccagctttatttgccactgaaaaaatgttcagaatgcttactaatatctggacagtgatcaatcattttagtgtctggttagctacaggcctcggtactttttattttctcaagatagccaatttttctaactctatttttctctacctaaagtggagggttaaaaaggtggttttggtgctgcttcttgtgacttcggtcttcttgtttttaaatattgcactgataaacatccatataaatgccagtatcaatggatacagaagaaacaagacttgcagttctgattcaagtaactttacacgattttccagtcttattgtattaaccagcactgtgttcattttcataccctttactttgtccctggcaatgtttcttctcctcatcttctccatgtggaaacatcgcaagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttgaatatattagaaaaaaaatagctcctaagaaattcttgtatgttatataaactttatacttccttaagattctttcattgtgtataactttgtgaattttacaaagatatgcttggaatcaacaccatccaaacatatcacaaattaggatatatgaaagtatgtatattaccatacagagaagaatgcgaatactataaagagttcttatacaaacagataatatagattttgtatcaatcattcaccttttttgagatttttaaatgagaaaacctataatgtataaaatacatgtgtgtatgtatgtatgtgacacagttactaaaaataggcttcttaaacttacatctcaatctggtagataaagtacataaaagaatatggaattttagtacctatattaagtgtttttaatttttgtataatatttagtacctgattagcgtgtatgcaaaaaagtaatttgcttcgtttgttgaattagaagccagctgccttactaaactaccacatttgctttgctcattctcttggctttgcagatagaaaattatatcatctgcatatagtgacttataatgattattttacttctccattttactacttgtaattcttttttggtatcagttgtataatgaaatggtttgaacattcaaagtgttaagtaatcctgatcgtaactgctgtctttgcaaatggagtgttttctagtgttttaacaataaacgtaatactgactctagctttgagataaattcttttaaaaatattattcagggagaatatttgtttcctatcttcctgtgtatagtattgtaataaaatctctgttaaaaactatcaaaaaaaa

SEQ ID NO: 449926 - DNA, 560 bp, Homo sapiens
ggggtgctgtgaacactgggtggatgctgctggtcctgctctcagtggtccttctggctctgagctcagctcagagcacagataatgatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449927 - DNA, 2360 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacagtaaagggagctgacacgtttctcccagcacaaagttgggagtgacaccagagcctcctgcaagatgcttctgattctgctgtcagtggccctgctggccttcagctcagctcaggatttaaatgaagatgtcagccaggaagatgttcccctcgtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagataacagtgtttcaaatgccgtgaaacatggcatcatgctctaacttcagtataccaataaaacaatcagcttgcaaaaatctg

SEQ ID NO: 449928 - DNA, 3084 bp, Homo sapiens
  misc_feature (39)..(39): n is a, c, g, or t
  misc_feature (76)..(76): n is a, c, g, or t
gttaaatcagtattcagtatttacataattatgactgantttacatgactactattattcacagttgatgtatacngtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctcccctaccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagagttggagtctcactctgttatccaggctggagttcagtggtaggatcatggcttactgcagtctggaactcctgggctcaaaccatcctcccacctcagccttctgctgcagaagaatattttgcctgctggaacctgctgtatctactcaagagtggaagttttcacagtaaagggagctgacacgtttctcccagcacaaagttgggagtgacaccagagcctcctgcaagatgcttctgattctgctgtcagtggccctgctggccttcagctcagctcaggatttaaatgaagatgtcagccaggaagatgttcccctcgtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggtacgattccagtttattatccatcaaaggctccaactgctacagttctccaacttcattgtgccaatgaatcctctgaaaacctgttaatattgccctgtcctggaacacatttctaaaaattgttattcagatattcttgtatagagtatcaagaccctgtgaccctgtgttttacagaagctcttgaaggcaattctgattttgagaatcactatcttcaaattacatgtcttaagtagggttgacaatgaggacatagaaccatgttccccctttggctctctctattttctttcctcaaactcagactcccatttaaagttttcacctgaacatgctttgctcagtcctgcctcacatcaggctttcaggtccagtattcctgctaagtggtccttgaactttcagttgtaaaatggtatctcatttttagtatacttacatttaaagtcatacatgcttaagctaacaaaaactaatctcactgaaccgaaatgtacagagctaaatagtaagagcctaactcatctttcctcccttctatccttctcaaaacccccaccttttactctttggaatctactttttgaaatatatattgctacataaatatatataatgcttttattacaagcacttataccatactgtatattcagatttgtgtcttactcactggaaaaatttattgtttagaaaactttctcatgagttca

SEQ ID NO: 449929 - DNA, 500 bp, Homo sapiens
tggctccatggtataggtggtctctgctgaggaccatcatcttggttccactttcaccataccatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449930 - DNA, 749 bp, Homo sapiens
catctctttgtacatagctgagaagtatctgcgtatagaagaatagaggcagagaaatatgaaggactaaggagaagggtatgagagtaaataggatttgtaatagccaacccagaagttaagtagaaagcctgttgcttttccttccttcatttatccaaccttaataccaggcaactgaagagggaaaagtcagattgcggtgtttgcaaacaccgcagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaattgtt

SEQ ID NO: 449931 - DNA, 599 bp, Homo sapiens
gattcaggaagtaacttttcccatcatcctgtacttcttttctagatgtcagccaggaagatgttcccctcgtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagataacagtgtttcaaatgccgtgaaacatggcatcatgctctaacttcagtataccaataaaacaatcagcttgcaaaaatctg

SEQ ID NO: 449932 - DNA, 1719 bp, Homo sapiens
gcatggttcctgacggaaacttgaccacctgcatcccagctgccaggccgcctccaccccattgggagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacacgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgtaacatttacctggtatctacatccttacctgcattggaaaatgtttgctacctcacaacaaccatttgcctcctttaagaacactgatgggctgcactttttggatagaaatagaatttgatttcagaatgtatgcttggtgagtctcagtgcccaggaacacttttggaataatttatcagacattgaacttctgtgattaatcgcttttatagatttactcagtctttaaaattcgtctctgatttgccagagaaaaacggtggtagccatggaaatcgggagtgaaggagcactgcttcattgtggctcagcccttcctaggggcctctgccctttgatgtccttgagctactcttcagctctggaagttgtggacaaaccgtaggaatgtatgtgtgcgtgtggtggagtgattgtctgtgaatgacaggccctggctattgattgatgttgcatcaatttagcaaattcatttcctcattcttgatggcctgaatatatgtctgcacttttaatgctcctcttaaccagttgtaacatcttaccatttccctaacaaattgaattagtttaataaaatcttttgacacatgttaaaaaagagaaaagagaaagacagcaaaaaccgtttggggagcgcttgggccacctggaaaggtttctgaaaccatctcgttggggcgcgggggccccagaggggaacaggcaacgtgtggcaaaagggggtccccagggaaaccgg

SEQ ID NO: 449933 - DNA, 2348 bp, Homo sapiens
gcgtgcgcggggcgggcgggtgcgcgcgcacttcctcctcgcccccacccagacccagaaggcgccaccatggcggcgcccccgcagcccgtcacccacctcatctttgacatggacggacttcttctgggttatacaggaagcatagtggcagctgcttcgggggagtcctcaagaggcttacaatcacggtggacggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccagacatcttcctagcttgtgccaagaggttctctccccctcctgctatggagaagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacacgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgtaacatttacctggtatctacatccttacctgcattggaaaatgtttgctacctcacaacaaccatttgcctcctttaagaacactgatgggctgcactttttggatagaaatagaatttgatttcagaatgtatgcttggtgagtctcagtgcccaggaacacttttggaataatttatcagacattgaacttctgtgattaatcgcttttatagatttactcagtctttaaaattcgtctctgatttgccagagaaaaacggtggtagccatggaaatcgggagtgaaggagcactgcttcattgtggctcagcccttcctaggggcctctgccctttgatgtccttgagctactcttcagctctggaagttgtggacaaaccgtaggaatgtatgtgtgcgtgtggtggagtgattgtctgtgaatgacaggccctggctattgattgatgttgcatcaatttagcaaattcatttcctcattcttgatggcctgaatatatgtctgcacttttaatgctcctcttaaccagttgtaacatcttaccatttccctaacaaattgaattagtttaataaaatcttttgacacatgttaaaaaagagaaaagagaaagacagcaaaaaccgtttggggagcgcttgggccacctggaaaggtttctgaaaccatctcgttggggcgcgggggccccagaggggaacaggcaacgtgtggcaaaagggggtccccagggaaaccgg

SEQ ID NO: 449934 - DNA, 2279 bp, Homo sapiens
gcgtgcgcggggcgggcgggtgcgcgcgcacttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccagacatcttcctagcttgtgccaagaggttctctccccctcctgctatggagaagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacacgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgtaacatttacctggtatctacatccttacctgcattggaaaatgtttgctacctcacaacaaccatttgcctcctttaagaacactgatgggctgcactttttggatagaaatagaatttgatttcagaatgtatgcttggtgagtctcagtgcccaggaacacttttggaataatttatcagacattgaacttctgtgattaatcgcttttatagatttactcagtctttaaaattcgtctctgatttgccagagaaaaacggtggtagccatggaaatcgggagtgaaggagcactgcttcattgtggctcagcccttcctaggggcctctgccctttgatgtccttgagctactcttcagctctggaagttgtggacaaaccgtaggaatgtatgtgtgcgtgtggtggagtgattgtctgtgaatgacaggccctggctattgattgatgttgcatcaatttagcaaattcatttcctcattcttgatggcctgaatatatgtctgcacttttaatgctcctcttaaccagttgtaacatcttaccatttccctaacaaattgaattagtttaataaaatcttttgacacatgttaaaaaagagaaaagagaaagacagcaaaaaccgtttggggagcgcttgggccacctggaaaggtttctgaaaccatctcgttggggcgcgggggccccagaggggaacaggcaacgtgtggcaaaagggggtccccagggaaaccgg

SEQ ID NO: 449935 - DNA, 964 bp, Homo sapiens
gcgtgcgcggggcgggcgggtgcgcgcgcacttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccagggcatcagctcttcacacagcaacagcttcctgcatgtggcccctgactgtccattgatgaccgaaggctcgtggacttgccaagttgcccacgtaaaacccagggttcagagagcgagacaagtccttgcattgtgaagtgccaacaattctagtattccaaagctcagtgttgttcagaacatggtacccttgtgagatcacgtgtgacatttgtgaagaacctggaactgatgtttccttaggaagcctcgcaacagggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccagacatcttcctagcttgtgccaagaggttctctccccctcctgctatggagaagagctccatccatagacctcgtctgctcaccgcacagaaatgccagggctgccgggatcccttctcagcgctcctccttctgtgtaatcaactgcttctctgctctgatgacacctgaccgcacctc

SEQ ID NO: 449936 - DNA, 1690 bp, Homo sapiens
gttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgtcaaacgcgaggttttccgtttccttccggggcaagttgaacctgtccagcccccgtaggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagagtgacctcagttctgtgactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaag

SEQ ID NO: 449937 - DNA, 2444 bp, Homo sapiens
attcgtgtgcactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtctgtacaaaataaagtgcaagcagtgtaaaattgaagtctgtctttgtttcaaaatgattaagattaaatgatgaaataatattttatagccactgcattggatacttggattgtttttcaagcatcttcttatgactaaatcttctgtttcattctgttttaaatctaaaaagtaaaatgatggtcacttggaatctgctctatattttaattatagtctcttctgtttataaacaataacttacacatatttttcatagttttaagtaaagattaaataatgccatcttagaaaggatctgtttaacctatattataaaagttagatacacaatttggtacattaaatgaaaatgtcatttgcatatatagaacctgttctgttttacacagtatcataatagctacagctactacaagaaatatggttaatggaagtcaaacatttagtacgatgcttaaagagttactttaataatgccctcttatttttctagttagatagcaactatatttcccagacaagcaagaaaatatatggggcattttttataaatttaaaagtagctagcacaatccaaccacgcaactttttttgaaatagcttgcaatgctatgattccaaagtgatcaaggtacttgaagagcaaaaatggcttgaatagaatggaaatgtaggcaagtggacagatagcatctagattgaatttgttacaggtggtatattagcaaagaaatagaaaaatgaaatggaagaaatataccaattcccattatttcatgtaaaaagaatggctaatttaactacagatgttagcacatgaagacattgttttaaagttttttttcttatagtatctttgtctgggtaatactggtcaaataaaatgagttgggaagtatttcctcctcttctgtttcctggaagagattgtttagaattgatattatttctcccttaagtgtttggtaaaattcatcacggaagttatctgggcctgtagttttctttactggaaggtttttaacttaaccacaaactcaatttccttaataaatatggttctgtttaggttatctgtttctacagtgagctttctagtttgtatcctatagggaatctgtttcatctaagttgttaaatatacaatccttgagttggtcatggtgttttctagttagccttttaataactatagtgtctgtagtgtattccctttcatttctgacactgaatttgtatcttctgtttttctaggcagtcagctagaagcttatcttattgctctaaaagcatttttaatgcactcaagatagttatgctagaaactttaacttcttattcaacactgaatatgagtgactaatttttaattaaggatctattttgctttttatatcacagtaatgacttctatgtgttagtagtagtacttcgttctgtgtaatactggaatactaggagttcattctaacttaatgaaaatcaaagttggcttagatggaatatgaatttaacttctgagggccgaagacttaaattgtgctctttttaaattctgcagaactatatatcttcatacagatcttcgttgtagctttgtttggcccaggtgcttaggtgtttgcaggtctgagaaacctctaacctagtgttcctctaaattagagtccttggatctgtatcaaaaccacctagtgtactgtttaaaaatggccattcctaggccttattacaggacctactgtatcagaattgaacacgtggccctgaatctgcatctttaatgaattatccaggtgattcttacaatgaagttatagaactactgttctaatgtcacaaaggagaaagagaaaagttggattttaaacttcaagatacaaaataattagtttcttagtctcttttttttttttttttgaaatggagtcttgctctgtcacccaggctggagtgcagtggcgcaatcttggctcactgcaacctctgcctctcaggttcgagcaattctcatgcttcagcctcccaagtagctgggactacgggtgcccgccaccaagccaggctaatttttgtattttcagtagaggtgggtttcaccatgttggccaggctggtctcaaactcctgacctcaggtgatcccccctgccttggcctcccaaagtgctgggattacaggcatgagccacagcgcccggccaattagtcttttgataagggttctataaggcctaatcatctgcattattactcatttaat

SEQ ID NO: 449938 - DNA, 5232 bp, Homo sapiens
gttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgtcaaacgcgaggttttccgtttccttccggggcaagttgaacctgtccagcccccgtaggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagagtgacctcagttctgtgactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagccaaaaacccctgggtttttttctcattgattaagccacttatttttataaggtatatttaaataattcccatcttctgatatgattttaaactctaaatcatgtgttactgttacaaaactttctctctccatgtaatcacacttagttatgagcaaagcagtgagaaagttgaggtgataaacaactttgcagcattaatgtaacaaaaagtttcagtatttgtcaggaaaacaaaagcttaggctgttaaataaaagctattctattttggtaagttgaaattcaagaatgtatatataatttcttaaatgtaagagtgcattaaatcaaatacaaaaattggtttttcaatgcatcattatttattgccataacaaattgtttggtccaaaatgaaagctatattcagaaggtttgcacctcaaaattgagtaataattaatgaaatgtctgtacaaaataaagtgcaagcagtgtaaaattgaagtctgtctttgtttcaaaatgattaagattaaatgatgaaataatattttatagccactgcattggatacttggattgtttttcaagcatcttcttatgactaaatcttctgtttcattctgttttaaatctaaaaagtaaaatgatggtcacttggaatctgctctatattttaattatagtctcttctgtttataaacaataacttacacatatttttcatagttttaagtaaagattaaataatgccatcttagaaaggatctgtttaacctatattataaaagttagatacacaatttggtacattaaatgaaaatgtcatttgcatatatagaacctgttctgttttacacagtatcataatagctacagctactacaagaaatatggttaatggaagtcaaacatttagtacgatgcttaaagagttactttaataatgccctcttatttttctagttagatagcaactatatttcccagacaagcaagaaaatatatggggcattttttataaatttaaaagtagctagcacaatccaaccacgcaactttttttgaaatagcttgcaatgctatgattccaaagtgatcaaggtacttgaagagcaaaaatggcttgaatagaatggaaatgtaggcaagtggacagatagcatctagattgaatttgttacaggtggtatattagcaaagaaatagaaaaatgaaatggaagaaatataccaattcccattatttcatgtaaaaagaatggctaatttaactacagatgttagcacatgaagacattgttttaaagttttttttcttatagtatctttgtctgggtaatactggtcaaataaaatgagttgggaagtatttcctcctcttctgtttcctggaagagattgtttagaattgatattatttctcccttaagtgtttggtaaaattcatcacggaagttatctgggcctgtagttttctttactggaaggtttttaacttaaccacaaactcaatttccttaataaatatggttctgtttaggttatctgtttctacagtgagctttctagtttgtatcctatagggaatctgtttcatctaagttgttaaatatacaatccttgagttggtcatggtgttttctagttagccttttaataactatagtgtctgtagtgtattccctttcatttctgacactgaatttgtatcttctgtttttctaggcagtcagctagaagcttatcttattgctctaaaagcatttttaatgcactcaagatagttatgctagaaactttaacttcttattcaacactgaatatgagtgactaatttttaattaaggatctattttgctttttatatcacagtaatgacttctatgtgttagtagtagtacttcgttctgtgtaatactggaatactaggagttcattctaacttaatgaaaatcaaagttggcttagatggaatatgaatttaacttctgagggccgaagacttaaattgtgctctttttaaattctgcagaactatatatcttcatacagatcttcgttgtagctttgtttggcccaggtgcttaggtgtttgcaggtctgagaaacctctaacctagtgttcctctaaattagagtccttggatctgtatcaaaaccacctagtgtactgtttaaaaatggccattcctaggccttattacaggacctactgtatcagaattgaacacgtggccctgaatctgcatctttaatgaattatccaggtgattcttacaatgaagttatagaactactgttctaatgtcacaaaggagaaagagaaaagttggattttaaacttcaagatacaaaataattagtttcttagtctcttttttttttttttttgaaatggagtcttgctctgtcacccaggctggagtgcagtggcgcaatcttggctcactgcaacctctgcctctcaggttcgagcaattctcatgcttcagcctcccaagtagctgggactacgggtgcccgccaccaagccaggctaatttttgtattttcagtagaggtgggtttcaccatgttggccaggctggtctcaaactcctgacctcaggtgatcccccctgccttggcctcccaaagtgctgggattacaggcatgagccacagcgcccggccaattagtcttttgataagggttctataaggcctaatcatctgcattattactcatttaat

SEQ ID NO: 449939 - DNA, 5170 bp, Homo sapiens
gttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgtcaaacgcgaggttttccgtttccttccggggcaagttgaacctgtccagcccccgtaggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagccaaaaacccctgggtttttttctcattgattaagccacttatttttataaggtatatttaaataattcccatcttctgatatgattttaaactctaaatcatgtgttactgttacaaaactttctctctccatgtaatcacacttagttatgagcaaagcagtgagaaagttgaggtgataaacaactttgcagcattaatgtaacaaaaagtttcagtatttgtcaggaaaacaaaagcttaggctgttaaataaaagctattctattttggtaagttgaaattcaagaatgtatatataatttcttaaatgtaagagtgcattaaatcaaatacaaaaattggtttttcaatgcatcattatttattgccataacaaattgtttggtccaaaatgaaagctatattcagaaggtttgcacctcaaaattgagtaataattaatgaaatgtctgtacaaaataaagtgcaagcagtgtaaaattgaagtctgtctttgtttcaaaatgattaagattaaatgatgaaataatattttatagccactgcattggatacttggattgtttttcaagcatcttcttatgactaaatcttctgtttcattctgttttaaatctaaaaagtaaaatgatggtcacttggaatctgctctatattttaattatagtctcttctgtttataaacaataacttacacatatttttcatagttttaagtaaagattaaataatgccatcttagaaaggatctgtttaacctatattataaaagttagatacacaatttggtacattaaatgaaaatgtcatttgcatatatagaacctgttctgttttacacagtatcataatagctacagctactacaagaaatatggttaatggaagtcaaacatttagtacgatgcttaaagagttactttaataatgccctcttatttttctagttagatagcaactatatttcccagacaagcaagaaaatatatggggcattttttataaatttaaaagtagctagcacaatccaaccacgcaactttttttgaaatagcttgcaatgctatgattccaaagtgatcaaggtacttgaagagcaaaaatggcttgaatagaatggaaatgtaggcaagtggacagatagcatctagattgaatttgttacaggtggtatattagcaaagaaatagaaaaatgaaatggaagaaatataccaattcccattatttcatgtaaaaagaatggctaatttaactacagatgttagcacatgaagacattgttttaaagttttttttcttatagtatctttgtctgggtaatactggtcaaataaaatgagttgggaagtatttcctcctcttctgtttcctggaagagattgtttagaattgatattatttctcccttaagtgtttggtaaaattcatcacggaagttatctgggcctgtagttttctttactggaaggtttttaacttaaccacaaactcaatttccttaataaatatggttctgtttaggttatctgtttctacagtgagctttctagtttgtatcctatagggaatctgtttcatctaagttgttaaatatacaatccttgagttggtcatggtgttttctagttagccttttaataactatagtgtctgtagtgtattccctttcatttctgacactgaatttgtatcttctgtttttctaggcagtcagctagaagcttatcttattgctctaaaagcatttttaatgcactcaagatagttatgctagaaactttaacttcttattcaacactgaatatgagtgactaatttttaattaaggatctattttgctttttatatcacagtaatgacttctatgtgttagtagtagtacttcgttctgtgtaatactggaatactaggagttcattctaacttaatgaaaatcaaagttggcttagatggaatatgaatttaacttctgagggccgaagacttaaattgtgctctttttaaattctgcagaactatatatcttcatacagatcttcgttgtagctttgtttggcccaggtgcttaggtgtttgcaggtctgagaaacctctaacctagtgttcctctaaattagagtccttggatctgtatcaaaaccacctagtgtactgtttaaaaatggccattcctaggccttattacaggacctactgtatcagaattgaacacgtggccctgaatctgcatctttaatgaattatccaggtgattcttacaatgaagttatagaactactgttctaatgtcacaaaggagaaagagaaaagttggattttaaacttcaagatacaaaataattagtttcttagtctcttttttttttttttttgaaatggagtcttgctctgtcacccaggctggagtgcagtggcgcaatcttggctcactgcaacctctgcctctcaggttcgagcaattctcatgcttcagcctcccaagtagctgggactacgggtgcccgccaccaagccaggctaatttttgtattttcagtagaggtgggtttcaccatgttggccaggctggtctcaaactcctgacctcaggtgatcccccctgccttggcctcccaaagtgctgggattacaggcatgagccacagcgcccggccaattagtcttttgataagggttctataaggcctaatcatctgcattattactcatttaat

SEQ ID NO: 449940 - DNA, 4521 bp, Homo sapiens
ctttgatttgcaggcatgaactaatcacatttgtggttaatattttttcttcatatagataagatatttttgttgagataaatattttaaatgccaccacaccttggtggatatttttttcatatcctcagacgactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagccaaaaacccctgggtttttttctcattgattaagccacttatttttataaggtatatttaaataattcccatcttctgatatgattttaaactctaaatcatgtgttactgttacaaaactttctctctccatgtaatcacacttagttatgagcaaagcagtgagaaagttgaggtgataaacaactttgcagcattaatgtaacaaaaagtttcagtatttgtcaggaaaacaaaagcttaggctgttaaataaaagctattctattttggtaagttgaaattcaagaatgtatatataatttcttaaatgtaagagtgcattaaatcaaatacaaaaattggtttttcaatgcatcattatttattgccataacaaattgtttggtccaaaatgaaagctatattcagaaggtttgcacctcaaaattgagtaataattaatgaaatgtctgtacaaaataaagtgcaagcagtgtaaaattgaagtctgtctttgtttcaaaatgattaagattaaatgatgaaataatattttatagccactgcattggatacttggattgtttttcaagcatcttcttatgactaaatcttctgtttcattctgttttaaatctaaaaagtaaaatgatggtcacttggaatctgctctatattttaattatagtctcttctgtttataaacaataacttacacatatttttcatagttttaagtaaagattaaataatgccatcttagaaaggatctgtttaacctatattataaaagttagatacacaatttggtacattaaatgaaaatgtcatttgcatatatagaacctgttctgttttacacagtatcataatagctacagctactacaagaaatatggttaatggaagtcaaacatttagtacgatgcttaaagagttactttaataatgccctcttatttttctagttagatagcaactatatttcccagacaagcaagaaaatatatggggcattttttataaatttaaaagtagctagcacaatccaaccacgcaactttttttgaaatagcttgcaatgctatgattccaaagtgatcaaggtacttgaagagcaaaaatggcttgaatagaatggaaatgtaggcaagtggacagatagcatctagattgaatttgttacaggtggtatattagcaaagaaatagaaaaatgaaatggaagaaatataccaattcccattatttcatgtaaaaagaatggctaatttaactacagatgttagcacatgaagacattgttttaaagttttttttcttatagtatctttgtctgggtaatactggtcaaataaaatgagttgggaagtatttcctcctcttctgtttcctggaagagattgtttagaattgatattatttctcccttaagtgtttggtaaaattcatcacggaagttatctgggcctgtagttttctttactggaaggtttttaacttaaccacaaactcaatttccttaataaatatggttctgtttaggttatctgtttctacagtgagctttctagtttgtatcctatagggaatctgtttcatctaagttgttaaatatacaatccttgagttggtcatggtgttttctagttagccttttaataactatagtgtctgtagtgtattccctttcatttctgacactgaatttgtatcttctgtttttctaggcagtcagctagaagcttatcttattgctctaaaagcatttttaatgcactcaagatagttatgctagaaactttaacttcttattcaacactgaatatgagtgactaatttttaattaaggatctattttgctttttatatcacagtaatgacttctatgtgttagtagtagtacttcgttctgtgtaatactggaatactaggagttcattctaacttaatgaaaatcaaagttggcttagatggaatatgaatttaacttctgagggccgaagacttaaattgtgctctttttaaattctgcagaactatatatcttcatacagatcttcgttgtagctttgtttggcccaggtgcttaggtgtttgcaggtctgagaaacctctaacctagtgttcctctaaattagagtccttggatctgtatcaaaaccacctagtgtactgtttaaaaatggccattcctaggccttattacaggacctactgtatcagaattgaacacgtggccctgaatctgcatctttaatgaattatccaggtgattcttacaatgaagttatagaactactgttctaatgtcacaaaggagaaagagaaaagttggattttaaacttcaagatacaaaataattagtttcttagtctcttttttttttttttttgaaatggagtcttgctctgtcacccaggctggagtgcagtggcgcaatcttggctcactgcaacctctgcctctcaggttcgagcaattctcatgcttcagcctcccaagtagctgggactacgggtgcccgccaccaagccaggctaatttttgtattttcagtagaggtgggtttcaccatgttggccaggctggtctcaaactcctgacctcaggtgatcccccctgccttggcctcccaaagtgctgggattacaggcatgagccacagcgcccggccaattagtcttttgataagggttctataaggcctaatcatctgcattattactcatttaat

SEQ ID NO: 449941 - DNA, 5147 bp, Homo sapiens
gttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgtcaaacgcgaggttttccgtttccttccggggcaagttgaacctgtccagcccccgtaggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagagtgacctcagttctgtgactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagccaaaaacccctgggtttttttctcattgattaagccacttatttttataaggtatatttaaataattcccatcttctgatatgattttaaactctaaatcatgtgttactgttacaaaactttctctctccatgtaatcacacttagttatgagcaaagcagtgagaaagttgaggtgataaacaactttgcagcattaatgtaacaaaaagtttcagtatttgtcaggaaaacaaaagcttaggctgttaaataaaagctattctattttggtaagttgaaattcaagaatgtatatataatttcttaaatgtaagagtgcattaaatcaaatacaaaaattggtttttcaatgcatcattatttattgccataacaaattgtttggtccaaaatgaaagctatattcagaaggtttgcacctcaaaattgagtaataattaatgaaatgtctgtacaaaataaagtgcaagcagtgtaaaattgaagtctgtctttgtttcaaaatgattaagattaaatgatgaaataatattttatagccactgcattggatacttggattgtttttcaagcatcttcttatgactaaatcttctgtttcattctgttttaaatctaaaaagtaaaatgatggtcacttggaatctgctctatattttaattatagtctcttctgtttataaacaataacttacacatatttttcatagttttaagtaaagattaaataatgccatcttagaaaggatctgtttaacctatattataaaagttagatacacaatttggtacattaaatgaaaatgtcatttgcatatatagaacctgttctgttttacacagtatcataatagctacagctactacaagaaatatggttaatggaagtcaaacatttagtacgatgcttaaagagttactttaataatgccctcttatttttctagttagatagcaactatatttcccagacaagcaagaaaatatatggggcattttttataaatttaaaagtagctagcacaatccaaccacgcaactttttttgaaatagcttgcaatgctatgattccaaagtgatcaaggtacttgaagagcaaaaatggcttgaatagaatggaaatgtaggcaagtggacagatagcatctagattgaatttgttacaggtggtatattagcaaagaaatagaaaaatgaaatggaagaaatataccaattcccattatttcatgtaaaaagaatggctaatttaactacagatgttagcacatgaagacattgttttaaagttttttttcttatagtatctttgtctgggtaatactggtcaaataaaatgagttgggaagtatttcctcctcttctgtttcctggaagagattgtttagaattgatattatttctcccttaagtgtttggtaaaattcatcacggaagttatctgggcctgtagttttctttactggaaggtttttaacttaaccacaaactcaatttccttaataaatatggttctgtttaggttatctgtttctacagtgagctttctagtttgtatcctatagggaatctgtttcatctaagttgttaaatatacaatccttgagttggtcatggtgttttctagttagccttttaataactatagtgtctgtagtgtattccctttcatttctgacactgaatttgtatcttctgtttttctaggcagtcagctagaagcttatcttattgctctaaaagcatttttaatgcactcaagatagttatgctagaaactttaacttcttattcaacactgaatatgagtgactaatttttaattaaggatctattttgctttttatatcacagtaatgacttctatgtgttagtagtagtacttcgttctgtgtaatactggaatactaggagttcattctaacttaatgaaaatcaaagttggcttagatggaatatgaatttaacttctgagggccgaagacttaaattgtgctctttttaaattctgcagaactatatatcttcatacagatcttcgttgtagctttgtttggcccaggtgcttaggtgtttgcaggtctgagaaacctctaacctagtgttcctctaaattagagtccttggatctgtatcaaaaccacctagtgtactgtttaaaaatggccattcctaggccttattacaggacctactgtatcagaattgaacacgtggccctgaatctgcatctttaatgaattatccaggtgattcttacaatgaagttatagaactactgttctaatgtcacaaaggagaaagagaaaagttggattttaaacttcaagatacaaaataattagtttcttagtctcttttttttttttttttgaaatggagtcttgctctgtcacccaggctggagtgcagtggcgcaatcttggctcactgcaacctctgcctctcaggttcgagcaattctcatgcttcagcctcccaagtagctgggactacgggtgcccgccaccaagccaggctaatttttgtattttcagtagaggtgggtttcaccatgttggccaggctggtctcaaactcctgacctcaggtgatcccccctgccttggcctcccaaagtgctgggattacaggcatgagccacagcgcccggccaattagtcttttgataagggttctataaggcctaatcatctgcattattactcatttaat

SEQ ID NO: 449942 - DNA, 2507 bp, Homo sapiens
gttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgtcaaacgcgaggttttccgtttccttccggggcaagttgaacctgtccagcccccgtaggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagagtgacctcagttctgtgactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaaaaactaacctgccactaatagttatgtcatccctctttttaatcatcatcctagccctaagtctggcctttgagtgactacaaaaaggattagactgaaccgaata

SEQ ID NO: 449943 - DNA, 487 bp, Homo sapiens
cgtattgttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgtcaaacgcgaggttttccgtttccttccggggcaagttgaacctgtccagcccccgtaggctgtgggtcaaaagtgccggtcaaaatggaagtgaatccccctaaacaggagcacctgctggcgctaaaaggtaaacttttgcgaacctgattcccccttttctgtttccttgcattccctacttatcgaagcctttgccatgtaggcctcatccttcttaaacactcagtgctcgccctcctgctctgtcctttgccgccaagcgggaggaagcgatttctcct

SEQ ID NO: 449944 - DNA, 1571 bp, Homo sapiens
gttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgtcaaacgcgaggttttccgtttccttccggggcaagttgaacctgtccagcccccgtaggctgtgggtcaaaagtgccggtcaaaatggaagtgaatccccctaaacaggagcacctgctggcgctaaaaggtcctgtttccctctgatttggcaagagagacaatcttgcaataataaattaacattctagctctgaggagttcaactaagaaattttctcatcactaagagtaactggattactgcagaatgactacagaagtaatattacattatcgaccatgtgagagtgatcccacacaactgccaaaaattgcagaaaaagcaattcaagactttcctactcgtccgctatcaagatttataccttggtttccatatgatgggtccaagcttccactcagacctaaaagatcaccacctgtgatttctgaagaggcagctgaagatgtgaaacagtacttaaccatttcagaacatgatgctaagtcacacagttatgattgcacagtagatctattggagtttcaacctagcttgaaaaagcagcatttaacctggtcacacacactgaaggaacagactaattctggaaatctgggtaaacaatcagaaaagggaaaacagcacaagaggagatcttggagtatttcccttcccagcaataattgtactaaaaacgtttctcctttgtctaaaaaattgcaagatagtttaaaggcactaaatttacactcactttatagagcaagatggacaatagaacacactatttgtaacagccaaactctggaagacatttggacaaaactcaatcaaattattaggcacaatgaacttccatcttgtaatgctacaattcagaggcatttaggccaaatatgggtgttctgtgatattatgtattgtgaatatgtgggaagtcttcttaaaggaagattagctcttactggaaaaattaatttatttgtgcataaatatggtgttatttttagtatgtaatgaattccactgattgtcaaaaagaatattctgaatgaaatgaatatggattgaaatagataaaataatttttacaggttttaaaatttttaatgactttttagaattcctaggcttgtcaattaagtcaagaaattgctgagttctacttattggcagccttcttttaaatgtgataaattattgtttacactgaatttgaaggtaaaaatgttctgttccttttgttacaaactgtgattgaattagtcatgaattaagttgtatagtttggattttggttaatctctaaaatctaattttactgtatttttttccttacctcaagtgtaattttttaaaaaataaaactcgaaacaattctctttgga

SEQ ID NO: 449945 - DNA, 5175 bp, Homo sapiens
gttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgtcaaacgcgaggttttccgtttccttccggggcaagttgaacctgtccagcccccgtaggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagagtgacctcagttctgtgactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagccaaaaacccctgggtttttttctcattgattaagccacttatttttataaggtatatttaaataattcccatcttctgatatgattttaaactctaaatcatgtgttactgttacaaaactttctctctccatgtaatcacacttagttatgagcaaagcagtgagaaagttgaggtgataaacaactttgcagcattaatgtaacaaaaagtttcagtatttgtcaggaaaacaaaagcttaggctgttaaataaaagctattctattttggtaagttgaaattcaagaatgtatatataatttcttaaatgtaagagtgcattaaatcaaatacaaaaattggtttttcaatgcatcattatttattgccataacaaattgtttggtccaaaatgaaagctatattcagaaggtttgcacctcaaaattgagtaataattaatgaaatgtctgtacaaaataaagtgcaagcagtgtaaaattgaagtctgtctttgtttcaaaatgattaagattaaatgatgaaataatattttatagccactgcattggatacttggattgtttttcaagcatcttcttatgactaaatcttctgtttcattctgttttaaatctaaaaagtaaaatgatggtcacttggaatctgctctatattttaattatagtctcttctgtttataaacaataacttacacatatttttcatagttttaagtaaagattaaataatgccatcttagaaaggatctgtttaacctatattataaaagttagatacacaatttggtacattaaatgaaaatgtcatttgcatatatagaacctgttctgttttacacagtatcataatagctacagctactacaagaaatatggttaatggaagtcaaacatttagtacgatgcttaaagagttactttaataatgccctcttatttttctagttagatagcaactatatttcccagacaagcaagaaaatatatggggcattttttataaatttaaaagtagctagcacaatccaaccacgcaactttttttgaaatagcttgcaatgctatgattccaaagtgatcaaggtacttgaagagcaaaaatggcttgaatagaatggaaatgtaggcaagtggacagatagcatctagattgaatttgttacaggtggtatattagcaaagaaatagaaaaatgaaatggaagaaatataccaattcccattatttcatgtaaaaagaatggctaatttaactacagatgttagcacatgaagacattgttttaaagttttttttcttatagtatctttgtctgggtaatactggtcaaataaaatgagttgggaagtatttcctcctcttctgtttcctggaagagattgtttagaattgatattatttctcccttaagtgtttggtaaaattcatcacggaagttatctgggcctgtagttttctttactggaaggtttttaacttaaccacaaactcaatttccttaataaatatggttctgtttaggttatctgtttctacagtgagctttctagtttgtatcctatagggaatctgtttcatctaagttgttaaatatacaatccttgagttggtcatggtgttttctagttagccttttaataactatagtgtctgtagtgtattccctttcatttctgacactgaatttgtatcttctgtttttctaggcagtcagctagaagcttatcttattgctctaaaagcatttttaatgcactcaagatagttatgctagaaactttaacttcttattcaacactgaatatgagtgactaatttttaattaaggatctattttgctttttatatcacagtaatgacttctatgtgttagtagtagtacttcgttctgtgtaatactggaatactaggagttcattctaacttaatgaaaatcaaagttggcttagatggaatatgaatttaacttctgagggccgaagacttaaattgtgctctttttaaattctgcagaactatatatcttcatacagatcttcgttgtagctttgtttggcccaggtgcttaggtgtttgcaggtctgagaaacctctaacctagtgttcctctaaattagagtccttggatctgtatcaaaaccacctagtgtactgtttaaaaatggccattcctaggccttattacaggacctactgtatcagaattgaacacgtggccctgaatctgcatctttaatgaattatccaggtgattcttacaatgaagttatagaactactgttctaatgtcacaaaggagaaagagaaaagttggattttaaacttcaagatacaaaataattagtttcttagtctcttttttttttttttttgaaatggagtcttgctctgtcacccaggctggagtgcagtggcgcaatcttggctcactgcaacctctgcctctcaggttcgagcaattctcatgcttcagcctcccaagtagctgggactacgggtgcccgccaccaagccaggctaatttttgtattttcagtagaggtgggtttcaccatgttggccaggctggtctcaaactcctgacctcaggtgatcccccctgccttggcctcccaaagtgctgggattacaggcatgagccacagcgcccggccaattagtcttttgataagggttctataaggcctaatcatctgcattattactcatttaat

SEQ ID NO: 449946 - DNA, 5259 bp, Homo sapiens
gttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgtcaaacgcgaggttttccgtttccttccggggcaagttgaacctgtccagcccccgtaggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcacgcaccacacaaattttttcccctttttttccaaaaaaatttcaggttctcaaaccattggcatgtgaaaaccaaattttacaatgcagagagtgacctcagttctgtggactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagccaaaaacccctgggtttttttctcattgattaagccacttatttttataaggtatatttaaataattcccatcttctgatatgattttaaactctaaatcatgtgttactgttacaaaactttctctctccatgtaatcacacttagttatgagcaaagcagtgagaaagttgaggtgataaacaactttgcagcattaatgtaacaaaaagtttcagtatttgtcaggaaaacaaaagcttaggctgttaaataaaagctattctattttggtaagttgaaattcaagaatgtatatataatttcttaaatgtaagagtgcattaaatcaaatacaaaaattggtttttcaatgcatcattatttattgccataacaaattgtttggtccaaaatgaaagctatattcagaaggtttgcacctcaaaattgagtaataattaatgaaatgtctgtacaaaataaagtgcaagcagtgtaaaattgaagtctgtctttgtttcaaaatgattaagattaaatgatgaaataatattttatagccactgcattggatacttggattgtttttcaagcatcttcttatgactaaatcttctgtttcattctgttttaaatctaaaaagtaaaatgatggtcacttggaatctgctctatattttaattatagtctcttctgtttataaacaataacttacacatatttttcatagttttaagtaaagattaaataatgccatcttagaaaggatctgtttaacctatattataaaagttagatacacaatttggtacattaaatgaaaatgtcatttgcatatatagaacctgttctgttttacacagtatcataatagctacagctactacaagaaatatggttaatggaagtcaaacatttagtacgatgcttaaagagttactttaataatgccctcttatttttctagttagatagcaactatatttcccagacaagcaagaaaatatatggggcattttttataaatttaaaagtagctagcacaatccaaccacgcaactttttttgaaatagcttgcaatgctatgattccaaagtgatcaaggtacttgaagagcaaaaatggcttgaatagaatggaaatgtaggcaagtggacagatagcatctagattgaatttgttacaggtggtatattagcaaagaaatagaaaaatgaaatggaagaaatataccaattcccattatttcatgtaaaaagaatggctaatttaactacagatgttagcacatgaagacattgttttaaagttttttttcttatagtatctttgtctgggtaatactggtcaaataaaatgagttgggaagtatttcctcctcttctgtttcctggaagagattgtttagaattgatattatttctcccttaagtgtttggtaaaattcatcacggaagttatctgggcctgtagttttctttactggaaggtttttaacttaaccacaaactcaatttccttaataaatatggttctgtttaggttatctgtttctacagtgagctttctagtttgtatcctatagggaatctgtttcatctaagttgttaaatatacaatccttgagttggtcatggtgttttctagttagccttttaataactatagtgtctgtagtgtattccctttcatttctgacactgaatttgtatcttctgtttttctaggcagtcagctagaagcttatcttattgctctaaaagcatttttaatgcactcaagatagttatgctagaaactttaacttcttattcaacactgaatatgagtgactaatttttaattaaggatctattttgctttttatatcacagtaatgacttctatgtgttagtagtagtacttcgttctgtgtaatactggaatactaggagttcattctaacttaatgaaaatcaaagttggcttagatggaatatgaatttaacttctgagggccgaagacttaaattgtgctctttttaaattctgcagaactatatatcttcatacagatcttcgttgtagctttgtttggcccaggtgcttaggtgtttgcaggtctgagaaacctctaacctagtgttcctctaaattagagtccttggatctgtatcaaaaccacctagtgtactgtttaaaaatggccattcctaggccttattacaggacctactgtatcagaattgaacacgtggccctgaatctgcatctttaatgaattatccaggtgattcttacaatgaagttatagaactactgttctaatgtcacaaaggagaaagagaaaagttggattttaaacttcaagatacaaaataattagtttcttagtctcttttttttttttttttgaaatggagtcttgctctgtcacccaggctggagtgcagtggcgcaatcttggctcactgcaacctctgcctctcaggttcgagcaattctcatgcttcagcctcccaagtagctgggactacgggtgcccgccaccaagccaggctaatttttgtattttcagtagaggtgggtttcaccatgttggccaggctggtctcaaactcctgacctcaggtgatcccccctgccttggcctcccaaagtgctgggattacaggcatgagccacagcgcccggccaattagtcttttgataagggttctataaggcctaatcatctgcattattactcatttaat

SEQ ID NO: 449947 - DNA, 5233 bp, Homo sapiens
gttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgtcaaacgcgaggttttccgtttccttccggggcaagttgaacctgtccagcccccgtaggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagagtgacctcagttctgtgactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagccaaaaacccctgggtttttttctcattgattaagccacttatttttataaggtatatttaaataattcccatcttctgatatgattttaaactctaaatcatgtgttactgttacaaaactttctctctccatgtaatcacacttagttatgagcaaagcagtgagaaagttgaggtgataaacaactttgcagcattaatgtaacaaaaagtttcagtatttgtcaggaaaacaaaagcttaggctgttaaataaaagctattctattttggtaagttgaaattcaagaatgtatatataatttcttaaatgtaagagtgcattaaatcaaatacaaaaattggtttttcaatgcatcattatttattgccataacaaattgtttggtccaaaatgaaagcttttgccgggggttttccccccccctgggcccaccgccgggggctgttcccacaccggccgcggcccctcctggggtcgagcacccgctctgtctttgtttcaaaatgattaagattaaatgatgaaataatattttatagccactgcattggatacttggattgtttttcaagcatcttcttatgactaaatcttctgtttcattctgttttaaatctaaaaagtaaaatgatggtcacttggaatctgctctatattttaattatagtctcttctgtttataaacaataacttacacatatttttcatagttttaagtaaagattaaataatgccatcttagaaaggatctgtttaacctatattataaaagttagatacacaatttggtacattaaatgaaaatgtcatttgcatatatagaacctgttctgttttacacagtatcataatagctacagctactacaagaaatatggttaatggaagtcaaacatttagtacgatgcttaaagagttactttaataatgccctcttatttttctagttagatagcaactatatttcccagacaagcaagaaaatatatggggcattttttataaatttaaaagtagctagcacaatccaaccacgcaactttttttgaaatagcttgcaatgctatgattccaaagtgatcaaggtacttgaagagcaaaaatggcttgaatagaatggaaatgtaggcaagtggacagatagcatctagattgaatttgttacaggtggtatattagcaaagaaatagaaaaatgaaatggaagaaatataccaattcccattatttcatgtaaaaagaatggctaatttaactacagatgttagcacatgaagacattgttttaaagttttttttcttatagtatctttgtctgggtaatactggtcaaataaaatgagttgggaagtatttcctcctcttctgtttcctggaagagattgtttagaattgatattatttctcccttaagtgtttggtaaaattcatcacggaagttatctgggcctgtagttttctttactggaaggtttttaacttaaccacaaactcaatttccttaataaatatggttctgtttaggttatctgtttctacagtgagctttctagtttgtatcctatagggaatctgtttcatctaagttgttaaatatacaatccttgagttggtcatggtgttttctagttagccttttaataactatagtgtctgtagtgtattccctttcatttctgacactgaatttgtatcttctgtttttctaggcagtcagctagaagcttatcttattgctctaaaagcatttttaatgcactcaagatagttatgctagaaactttaacttcttattcaacactgaatatgagtgactaatttttaattaaggatctattttgctttttatatcacagtaatgacttctatgtgttagtagtagtacttcgttctgtgtaatactggaatactaggagttcattctaacttaatgaaaatcaaagttggcttagatggaatatgaatttaacttctgagggccgaagacttaaattgtgctctttttaaattctgcagaactatatatcttcatacagatcttcgttgtagctttgtttggcccaggtgcttaggtgtttgcaggtctgagaaacctctaacctagtgttcctctaaattagagtccttggatctgtatcaaaaccacctagtgtactgtttaaaaatggccattcctaggccttattacaggacctactgtatcagaattgaacacgtggccctgaatctgcatctttaatgaattatccaggtgattcttacaatgaagttatagaactactgttctaatgtcacaaaggagaaagagaaaagttggattttaaacttcaagatacaaaataattagtttcttagtctcttttttttttttttttgaaatggagtcttgctctgtcacccaggctggagtgcagtggcgcaatcttggctcactgcaacctctgcctctcaggttcgagcaattctcatgcttcagcctcccaagtagctgggactacgggtgcccgccaccaagccaggctaatttttgtattttcagtagaggtgggtttcaccatgttggccaggctggtctcaaactcctgacctcaggtgatcccccctgccttggcctcccaaagtgctgggattacaggcatgagccacagcgcccggccaattagtcttttgataagggttctataaggcctaatcatctgcattattactcatttaat

SEQ ID NO: 449948 - DNA, 2446 bp, Homo sapiens
  misc_feature (1546)..(1546): n is a, c, g, or t
  misc_feature (1563)..(1563): n is a, c, g, or t
  misc_feature (1993)..(1993): n is a, c, g, or t
gttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgtcaaacgcgaggttttccgtttccttccggggcaagttgaacctgtccagcccccgtaggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagagtgacctcagttctgtgactgatgaagtatttctggaagcccagattcagaatatgacaacctcacctatgtttatggagaaggtttcactggagccatctattatgtacaatgtaacagaattaaattcagtcagccaagctggagaatggtaaatattaatttatgaagtctttatccttgttttgaaagatacatgtttttctaaacatccattgctcttcagtgggtttttttttaatagactttttttaaagaatttgaggttcatagaaaaattcatcagaaagtagagtttccacataccctcttccactcctcacagtttctcttgttatttacgtcttgttttttattttatttttatttttatttatttatttatttatttattttttgaaagagtccagctctatgcagtggcatgatcttgatctaggctcactgtaacctccacctcccaggttcaagcaattttggtgcatcagcctcccaagctgctgggattacaggtgcatgccaccacgcttggttaatttttttatttttagtagagatggggtttcaccatattggccaggctggtcttcagctcctgacctcaagcgatctgcccaccttatcctcccaaagtgctgtccttacaggcgtgagccactgtgcctggcctacatcttgttttaatgtggtacatttactacaattgatgaaatgatantgacactgattactaantaatgtctataatttacattagaattcacactttttgttgtatgttttattgtttttggtttttggtttgttttgttttaagagacaggtctcattaatgttgcccaggctgaagtcaaatttctggactcaaacgatctcccaagtatctgggactatagtcaagcactgtaggttttgacaaatatataacatgtatccaccattactatattatgcaaaatagtttcactttccaaaaactctcctgtgctccatcttcatccctccattacataaaaataaagatcctagcccttttaatttcatgttttactattcaaagcatttggtcttttaagtctcataaaaatccagtgaggtaaatatgaatcctatcattgctatcctgcaaataataaaatggaggaatgtgaaggaatggtagagnagttaaaaagagtaagggtgaatgtgggtttaaaaaaagaaatactctctcaacatcaaaagaaaaggacataggaatagatggtttaatactttgtgaaaaggaaatacatacacctttccacagctaatttaaaagaggaagaataaatgtaaagttgacaataatacagataagaaagtaataggctgggtgtggtggctcatgcctgtaatcctaaccctttggaaggctgaggccagaggattgcttgaagctatgagttctagaccaacctgggcaacttggcattttttttatttagctgggcatggtggtacactcctgcattcctagctccttgggagagaggcaggaaaatcgcttgagtccacaagttcaaggctgcagtgagccatgattgcaccactgtactccaacctggtgacagagagagaccttgtattttaaaca

SEQ ID NO: 449949 - DNA, 914 bp, Homo sapiens
cgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggta

SEQ ID NO: 449950 - DNA, 557 bp, Homo sapiens
  misc_feature (549)..(549): n is a, c, g, or t
  misc_feature (555)..(555): n is a, c, g, or t
cgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagcttttgttaagaacaagccagggaggggaccaattgccaaaagcttggggtaaaacntttggncc

SEQ ID NO: 449951 - DNA, 1769 bp, Homo sapiens
cgggtgccgggacaaactatacggctaggtacgaggctggtgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaactcagctctgactctctaggtttttgtgctgcgtaactaccaagtaaaaggactgagcctgtggctgagatgactcagtcaacgaaactgaggcacacggcagttaagtggaaactgcagaccaacacctggggtgtctccttctcttggctacttctagctcaggtttaatgggttgcttatcaagaggagagtcaggaaaaaaacgaatccaatgtattgagcatgagtgacaatgtattgagcatgagtgacaatgctagaagaaaagtcactttcagtgctgctcttgatggatttagggaaggattctttgttgtaggtaacagtgggctcaggggaaattatttttttcctaagagaaaattactttattcgtagcattttggaaatgttaggacctttacagaaattacattaccttgagaggtgaaatgatcgtccagcatcatgcaatggatagaaggttctgtaatcagctttaaaaaaaactttaatttttggccgggcacattggcttggctcatgcatgtaatcccagcactttgggaggccaaggcaggtggatcac

SEQ ID NO: 449952 - DNA, 1007 bp, Homo sapiens
cgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccatttggaataaaagcctagtattatattcctgcagcctgggctgctgagccccctgggggtctcgcggggtgacacgggcggggcgggtaccccgtctcggggacccccgggcaagggggcgcg

SEQ ID NO: 449953 - DNA, 1527 bp, Homo sapiens
  misc_feature (49)..(50): n is a, c, g, or t
tacaaaaagcagctgtaccgtccggaatccccggatatgtccctgctcnntccagagtggatgatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaactcagctctgactctctaggtttttgtgctgcgtaactaccaagtaaaaggactgagcctgtggctgagatgactcagtcaacgaaactgaggcacacggcagttaagtggaaactgcagaccaacacctggggtgtctccttctcttggctacttctagctcaggtttaatgggttgcttatcaagaggagagtcaggaaaaaaacgaatccaatgtattgagcatgagtgacaatgtattgagcatgagtgacaatgctagaagaaaagtcactttcagtgctgctcttgatggatttagggaaggattctttgttgtaggtaacagtgggctcaggggaaattatttttttcctaagagaaaattactttattcgtagcattttggaaatgttaggacctttacagaaattacattaccttgagaggtgaaatgatcgtccagcatcatgcaatggatagaaggttctgtaatcagctttaaaaaaaactttaatttttggccgggcacattggcttggctcatgcatgtaatcccagcactttgggaggccaaggcaggtggatcac

SEQ ID NO: 449954 - DNA, 316 bp, Homo sapiens
tttttcatgtatttgctagttgataatgtatttgccagataatataggcacttggtaaatttggaaggtttaataaatatcttggttataatgatggtaaaatgtattaacttctaaatttcagaaaagttggagaagatgagggatcatgaacgaaaggaagaaacttttaccccaatgcccagcccttactacatggaacttacgaagctcctgttaaatcagtaagtagatctcacctcttagaggccacacccaagactggactcgccatgcccttcccctaaccctcgtccttcctctccgcttccctgct

SEQ ID NO: 449955 - DNA, 1754 bp, Homo sapiens
cgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaactcagctctgactctctaggtttttgtgctgcgtaactaccaagtaaaaggactgagcctgtggctgagatgactcagtcaacgaaactgaggcacacggcagttaagtggaaactgcagaccaacacctggggtgtctccttctcttggctacttctagctcaggtttaatgggttgcttatcaagaggagagtcaggaaaaaaacgaatccaatgtattgagcatgagtgacaatgtattgagcatgagtgacaatgctagaagaaaagtcactttcagtgctgctcttgatggatttagggaaggattctttgttgtaggtaacagtgggctcaggggaaattatttttttcctaagagaaaattactttattcgtagcattttggaaatgttaggacctttacagaaattacattaccttgagaggtgaaatgatcgtccagcatcatgcaatggatagaaggttctgtaatcagctttaaaaaaaactttaatttttggccgggcacattggcttggctcatgcatgtaatcccagcactttgggaggccaaggcaggtggatcac

SEQ ID NO: 449956 - DNA, 1514 bp, Homo sapiens
cgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaacgcaacaaaaaaaaaaaaaaaaaaaaaaaaaaatttgggggggggcctggggccccggaaaaggtttttaaacccatcggtggggcgccggcgggcgcccaggaagggtaagggagcaaggggcgcccatagcgggtggtccccagaggagaaaccgcgggctccgaggaaccagggggcggggaattcttcccccatgtaaaaaaaagcccgcgggggaaaacggcgagggttttcggaacaattcccagaagggagtcccgggggcccacagggggactatacacccgggggctccaggaaccgcaatttcaattagcccccagggggc

SEQ ID NO: 449957 - DNA, 857 bp, Homo sapiens
cgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattaaaactcttgtagctcatatgagatcgccggagcagttccacttagg

SEQ ID NO: 449958 - DNA, 507 bp, Homo sapiens
ggaggttggggggcagagaagcccagtcagccatgatgaggtgaagttctcttcttcacctcagggggccagggtgtaaggggcgtcctgcagagcccccgtctcccactgtggccatctcaaagcctcagcccctctttcttccagaaacccccactgccttggcccatacctctccagctccctaggggcccaggctgggaggctggagactcagggtatggcccttgcttgacttagtctaagcttggggaggtggtccaagattgcgaggggtgggtacaggctgcggggtcgtctggtgcctttgggagctgtgctgctggggtcttgactcttgtaccccagagaccccacccccaccccccccccaccccgccgcgagcatgcgcaggcaccgcccctaccccctccggttcggttcgtttccggtttgtttgctgagctgtcaatgaaagacccgtgtaattattcccgagctttacaataaaagtgtgaaaaccggac

SEQ ID NO: 449959 - DNA, 4329 bp, Homo sapiens
agattttaaaaggtttaattaaattgatagatgatagatccatcatgaaaggtaaatttaaggggtgggggacattctgaatgtttttaggacaatgtcagtaaagggcagtgctcacccaagagacatatattggtatcactgtcagaatatagggccggatgaactgttgtgcttgtgaattattgggttacattattgaattgtgacccatttaatgacgtgttctgcttagcgtctttaggccccacctaactcttccagctctctattcgacattctctttggattgttttgctataacttgaaatttgggatgtcacaaacgaaactgtcatctgtttccgccaaactgtggttctgctaatctcccaggctggcagcattggagacttgctgacttctttcatcccccactcttttcacctgaaattcctttccttggttttgctctaagtcctatgcttcagtcaggggccaaccaaatctcactgcctcctttttatcatgaagcctttgatcactgatagttctttttatatcttgaaaaatcacccttcccagtacagttaatatttagtatctctactcatcttggcacttactcacagctccataattcagtgtttctcgtacctcttcatggtgatggggagccctttggaggtggtgactgtgctttatactcctcatgatgcttcacatgtggcaggcgtggagtgcccggaggcggccctcctgattctggggcctcccaggatggagcccctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatggagcaggtttactgtgcctgcccgtgttgggggccagcctgagccagcagtgggaggtggggccttagtgcctcaccgggcacacggattaggctgagtgaagattaagggagggtgtgctctgtggtctcctccctgccctctccccactggggagagacctgtgatttgccaagtccctggaccctggaccagctactgggccttatgggttgggggtggtaggcaggtgagcgtaagtggggagggaaatgggtaagaagtctactccaaacctaggtctctatgtcagaccagacctaggtgcttctctaggagggaaacagggagacctggggtcctgtggataactgagtggggagtctgccaggggagggcaccttcccattgtgccttctgtgtgtattgtgcattaacctcttcctcaccactaggcttctggggctgggtcccacatgcccttgaccctgacaataaagttctctat

SEQ ID NO: 449960 - DNA, 3750 bp, Homo sapiens
gccggagccggagcccgaactgcagctccagccccagccgtgcggagccgcagcccaggccggggccggcggcggctcatggacagcggggcgggcggccggcgctgcccggaggcggccctcctgattctggggcctcccaggatggagcccctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggctgggcctgaggcccaggagctatttgggctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatggagcaggtttactgtgcctgcccgtgttgggggccagcctgagccagcagtgggaggtggggccttagtgcctcaccgggcacacggattaggctgagtgaagattaagggagggtgtgctctgtggtctcctccctgccctctccccactggggagagacctgtgatttgccaagtccctggaccctggaccagctactgggccttatgggttgggggtggtaggcaggtgagcgtaagtggggagggaaatgggtaagaagtctactccaaacctaggtctctatgtcagaccagacctaggtgcttctctaggagggaaacagggagacctggggtcctgtggataactgagtggggagtctgccaggggagggcaccttcccattgtgccttctgtgtgtattgtgcattaacctcttcctcaccactaggcttctggggctgggtcccacatgcccttgaccctgacaataaagttctctat

SEQ ID NO: 449961 - DNA, 3895 bp, Homo sapiens
gccggagccggagcccgaactgcagctccagccccagccgtgcggagccgcagcccaggccggggccggcggcggctcatggacagcggggcgggcggccggcgctgcccggaggcggccctcctgattctggggcctcccaggatggagcccctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggctgggcctgaggcccaggagctatttgggctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccagagcctggtggactgggacctggaaaagagactgagaaagaaaagggagacagacagtcggggatagcaaataataatagcctaggtgccaggcaccgttctaaacacatgatgtgtattatatcatttaatccttacagtacaaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatggagcaggtttactgtgcctgcccgtgttgggggccagcctgagccagcagtgggaggtggggccttagtgcctcaccgggcacacggattaggctgagtgaagattaagggagggtgtgctctgtggtctcctccctgccctctccccactggggagagacctgtgatttgccaagtccctggaccctggaccagctactgggccttatgggttgggggtggtaggcaggtgagcgtaagtggggagggaaatgggtaagaagtctactccaaacctaggtctctatgtcagaccagacctaggtgcttctctaggagggaaacagggagacctggggtcctgtggataactgagtggggagtctgccaggggagggcaccttcccattgtgccttctgtgtgtattgtgcattaacctcttcctcaccactaggcttctggggctgggtcccacatgcccttgaccctgacaataaagttctctat

SEQ ID NO: 449962 - DNA, 4382 bp, Homo sapiens
gccggagccggagcccgaactgcagctccagccccagccgtgcggagccgcagcccaggccggggccggcggcggctcatggacagcggggcgggcggccggcgctgcccggaggcggccctcctgattctggggcctcccaggatggagcccctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggctgggcctgaggcccaggagctatttgggctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcagttacctcaccgccgcgtcaccttctcggccaccagccaggcccaggagctgcaggacccatcccagcacagttactatgacagtggcctggaggagtctgagacgccgtccagcaagtcatcctcagggcctcgactcggtcccctggccctgcctgaggatcactatgagcgcaccacccctgatggcagcataggagagatggagcaccccgagaatgaccttcgccctttgcctgatgtcgccatgacaggcacatgtacccgggagtgcagtgagtttggccactctgacacatgctggatgcctggccagtcatctcccagccgccggaccaagagcagcgccctcaaactctccaccttcatgccttaccaggaccgaggagggcaggagcctgcgggcgccggcagccccagccccccggaagaccggaacaccaaaacggcccccgtgcgcctcctgccctcctacagtgccttctcccacagtagccatgattcctgcaaggactcggccaccttggaggaaatccccctgacccagacctcggacttcccacccgcagccacaccggcatctgcccagacggccaagcgcgagatctacctgtgagccccctactggccggcccccctcccccagcgccggccagctcccaaatgcccattccagggcctcactctccaccccttcagcgtggacttcctgccagggcccaagtgggggtatcactgacctcatgaccacgctggcccttctcccatgcagggtccaggtcctctcccctcatttccatctcccagcccccaggggccccttcccctttatggggcttcccccagctgatgcccaagagggctcctctgcaatgactgggctccttcccttgacttccagggagcaccccctcgatttgggcagatggtggagtcaagggtgggcagcgtacttctaactcattgtttccctcatggccgaccagggcggggatagcatgcccaattttagccctgaagcagggctgaactggggagcccctttccctgggagctcccagaggaaactcttgaccaccagtggctccctgaagggcttttgttaccccctccggttcggttcgtttccggtttgtttgctgagctgtcaatgaaagacccgtgtaattattcccgagctttacaataaaagtgtgaaaaccggac

SEQ ID NO: 449963 - DNA, 2099 bp, Homo sapiens
gccggagccggagcccgaactgcagctccagccccagccgtgcggagccgcagcccaggccggggccggcggcggctcatggacagcggggcgggcggccggcgctgcccggaggcggccctcctgattctggggcctcccaggatggagcccctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggctgggcctgaggcccaggagctatttgggctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactaggactgccccggtcagactgccaccaccttcaactcatagctctcccgctgttcccgatccagagatgtcttacacctggatctctccagtctcgggtgagtcgctttccacata

SEQ ID NO: 449964 - DNA, 4917 bp, Homo sapiens
agattttaaaaggtttaattaaattgatagatgatagatccatcatgaaaggtaaatttaaggggtgggggacattctgaatgtttttaggacaatgtcagtaaagggcagtgctcacccaagagacatatattggtatcactgtcagaatatagggccggatgaactgttgtgcttgtgaattattgggttacattattgaattgtgacccatttaatgacgtgttctgcttagcgtctttaggccccacctaactcttccagctctctattcgacattctctttggattgttttgctataacttgaaatttgggatgtcacaaacgaaactgtcatctgtttccgccaaactgtggttctgctaatctcccaggctggcagcattggagacttgctgacttctttcatcccccactcttttcacctgaaattcctttccttggttttgctctaagtcctatgcttcagtcaggggccaaccaaatctcactgcctcctttttatcatgaagcctttgatcactgatagttctttttatatcttgaaaaatcacccttcccagtacagttaatatttagtatctctactcatcttggcacttactcacagctccataattcagtgtttctcgtacctcttcatggtgatggggagccctttggaggtggtgactgtgctttatactcctcatgatgcttcacatgtggcaggcgtggagtgcccggaggcggccctcctgattctggggcctcccaggatggagcccctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcagttacctcaccgccgcgtcaccttctcggccaccagccaggcccaggagctgcaggacccatcccagcacagttactatgacagtggcctggaggagtctgagacgccgtccagcaagtcatcctcagggcctcgactcggtcccctggccctgcctgaggatcactatgagcgcaccacccctgatggcagcataggagagatggagcaccccgagaatgaccttcgccctttgcctgatgtcgccatgacaggcacatgtacccgggagtgcagtgagtttggccactctgacacatgctggatgcctggccagtcatctcccagccgccggaccaagagcagcgccctcaaactctccaccttcatgccttaccaggaccgaggagggcaggagcctgcgggcgccggcagccccagccccccggaagaccggaacaccaaaacggcccccgtgcgcctcctgccctcctacagtgccttctcccacagtagccatgattcctgcaaggactcggccaccttggaggaaatccccctgacccagacctcggacttcccacccgcagccacaccggcatctgcccagacggccaagcgcgagatctacctgtgagccccctactggccggcccccctcccccagcgccggccagctcccaaatgcccattccagggcctcactctccaccccttcagcgtggacttcctgccagggcccaagtgggggtatcactgacctcatgaccacgctggcccttctcccatgcagggtccaggtcctctcccctcatttccatctcccagcccccaggggccccttcccctttatggggcttcccccagctgatgcccaagagggctcctctgcaatgactgggctccttcccttgacttccagggagcaccccctcgatttgggcagatggtggagtcaagggtgggcagcgtacttctaactcattgtttccctcatggccgaccagggcggggatagcatgcccaattttagccctgaagcagggctgaactggggagcccctttccctgggagctcccagaggaaactcttgaccaccagtggctccctgaagggcttttgttaccaaaggtggggtagggacgggggtgggagtggagcggaggccttgttttcccgtgg

SEQ ID NO: 449965 - DNA, 3771 bp, Homo sapiens
  misc_feature (3752)..(3753): n is a, c, g, or t
  misc_feature (3762)..(3762): n is a, c, g, or t
  misc_feature (3765)..(3765): n is a, c, g, or t
gccggagccggagcccgaactgcagctccagccccagccgtgcggagccgcagcccaggccggggccggcggcggctcatggacagcggggcgggcggccggcgctgcccggaggcggccctcctgattctggggcctcccaggatggagcccctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggctgggcctgaggcccaggagctatttgggctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatggagcaggtttactgtgcctgcccgtgttgggggccagcctgagccagcagtgggaggtggggccttagtgcctcaccgggcacacggattaggctgagtgaagattaagggagggtgtgctctgtggtctcctccctgccctctccccactggggagagacctgtgatttgccaagtccctggaccctggaccagctactgggccttatgggttgggggtggtaggcaggtgagcgtaagtggggagggaaatgggtaagaagtctactccaaacctaggtctctatgtcagaccagacctaggtgcttctctaggagggaaacagggagacctggggtcctgtggataactgagtggggagtctgccaggggagggcaccttcccattgtgccttctgtgtgtattgtgcattaacctcttcctcaccactaggcttctggggctgggtcccacatgcccttgaccctgacaataaagttctctatanngagaccaanaanaacaac

SEQ ID NO: 449966 - DNA, 1048 bp, Homo sapiens
  misc_feature (102)..(102): n is a, c, g, or t
  misc_feature (253)..(253): n is a, c, g, or t
tctcagactccacacatccccgccaaaccccagtcctgggtcttctgcattctggggacatggggacaccacgctggtcggtagggtcccaggctcttctcnatctctctcgggcccctcctctcctgctgccgctgccgcggtgagactccgaggcctgtaggaagcttcaggtgcctgagcctccagtacagcccttcccctactccacccaagcctccaggccacccctgttcctactgcagccaaatcnccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatggagcaggtttactgtgcctgcccgtgttgggggccagcctgagccagcagtgggaggtggggccttagtgcctcaccgggcacacggattaggctgagtgaagattaagggagggtgtgctctgtggtctcctccctgccctctccccactggggagagacctgtgatttgccaagtccctggaccctggaccagctactgggccttatgggttgggggtggtaggcaggtgagcgtaagtggggagggaaatgggtaagaagtctactccaaacctaggtctctatgtcagaccagacctaggtgcttctctaggagggaaacagggagacctggggtcctgtggataactgagtggggagtctgccaggggagggcaccttcccattgtgccttctgtgtgtattgtgcattaacctcttcctcaccactaggcttctggggctgggtcccacatgcccttgaccctgacaataaagttctctat

SEQ ID NO: 449967 - DNA, 2481 bp, Homo sapiens
cagggagagcgtgcccgggcacgacagcctggtgcacagccgagaaaacaacagcgcgtgcgcgtagcgacctctttgcgcctgcgccccccttgccagtctttcgccggcaaaaggaggacgtagaaaaggggacaccggaaactcactcttcacccggaaatggttattgaggaacatggcgttgctggtgcgagtccttacggagttttgctcttgttgcgcaagctggagtgcaatggcgtgatcttggctcactgcaacctctgcctcccgggttcaagcgattctcctgcctcagcctcctgagtagctgggattacagaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449968 - DNA, 2353 bp, Homo sapiens
cagggagagcgtgcccgggcacgacagcctggtgcacagccgagaaaacaacagcgcgtgcgcgtagcgacctctttgcgcctgcgccccccttgccagtctttcgccggcaaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449969 - DNA, 2232 bp, Homo sapiens
gattcttggaagggggaatgacctaaagcctaagatgaagtctcctggccctgcagcagtggcttctctggatgatgaccattttaatggcagagctgtctgcccctactgtcctagagaggtgatactggggcccactgaccaggggcccactagaggacaacagaggcatacatatgtttaaagcgtgagtgcctagcactgcatatatgcatattgttgaatctcttcatgtgtcctgtgaggtacctgtttctatcccctctctcaagacaagggaacttaaatctcagagaggggaagctgccaccctgggtagcagcactgggaagggacagaatcaggactctcacccagcagtgctggggtggacagcatggctgtgtgcgctgcaagccctgacttcctggcctgcaggagctgtctagggagggcgtgtaggggagacgtgtccttgggaggtgtgtgtctgtctccattcagaggtgtgatagggaattccctaactgcccccgccacccagctccccagtgactgctttctctgaaccaccttagtgaaattatctaggagatcagagacggcttggcctgggacggcttggtctgggacctgggatggtcagaagcccccctcatgccccgtccccttccttcctctcctctgggaggctggttcctgacgctggctcctcacctctgccctgcctctgtcgcttcctccttccccctcccctggttgcagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449970 - DNA, 2515 bp, Homo sapiens
cagggagagcgtgcccgggcacgacagcctggtgcacagccgagaaaacaacagcgcgtgcgcgtagcgacctctttgcgcctgcgccccccttgccagtctttcgccggcaaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtactaaaaacacacaacaaaacctaaacggcaaggagacaaaacaacaaaacaagggggggggaaaaattctcgggggagattacaa

SEQ ID NO: 449971 - DNA, 2330 bp, Homo sapiens
atttcctctattttacagataagaaaactgaaccacagagaggtattcctggccaggtgccgtggctcacacctgtaatcccagcacattgggaggctgagaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449972 - DNA, 2473 bp, Homo sapiens
cagggagagcgtgcccgggcacgacagcctggtgcacagccgagaaaacaacagcgcgtgcgcgtagcgacctctttgcgcctgcgccccccttgccagtctttcgccggcaaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccaggtcccctggttggaaacttctgcttcagaatggcatcctcagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449973 - DNA, 2335 bp, Homo sapiens
cagggagagcgtgcccgggcacgacagcctggtgcacagccgagaaaacaacagcgcgtgcgcgtagcgacctctttgcgcctgcgccccccttgccagtctttcgccggcaaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449974 - DNA, 2377 bp, Homo sapiens
cagggagagcgtgcccgggcacgacagcctggtgcacagccgagaaaacaacagcgcgtgcgcgtagcgacctctttgcgcctgcgccccccttgccagtctttcgccggcaaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagtcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449975 - DNA, 1553 bp, Homo sapiens
cagggagagcgtgcccgggcacgacagcctggtgcacagccgagaaaacaacagcgcgtgcgcgtagcgacctctttgcgcctgcgccccccttgccagtctttcgccggcaaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttc

SEQ ID NO: 449976 - DNA, 1803 bp, Homo sapiens
cagggagagcgtgcccgggcacgacagcctggtgcacagccgagaaaacaacagcgcgtgcgcgtagcgacctctttgcgcctgcgccccccttgccagtctttcgccggcaaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacaggtgagcgaccctttccctcccctcccaagtcctggcaacagtgggtcctcctcttgggctttcaggggatcatgagaggtggagttaccaaggaccagcctgagagaattctgaccagatcacatcagcactagacgctgaagaaggagcgccttctgtatgtccaaccatgaactgggccagggagcgggaaatgggaagagagagagaaagaggcatcgagtagtctcctgccctcaggaactttgagtcattcattcactgtgcacctcattgcctactgtgcgcccagtgctatgctagcagctgggcccacagagtcctggcagatatgagcacgtggtgtagtagcagctgcccactgtggaccccttctctacccacttggatttgtttcctgctcctgacttccagcaaaactgggcagcaggcagcatttcacagacagcctcttcctgctagatgctctccacagtcaagtagagtccccccacttcagtttctcacccctctggctccccagggctccccgacatcaaagcttctacgagaaagctccgcagtgggggctgcttacccacatagctgtcctcaagccccggggaattaattccttgacctccctgccctcagatcctgtattgatgggaaactcatacttgatagatgagtgagctgactggcagcgaagaggacatagaggctcttccagggcctcccagtgagtcagcctgcacagctgccctagggccccaagctgtgtgattcatgtgaccactgaggcctcagctgcctcagacagctcaggctgtgccatgagtcacacctttgcttcatggcctggcccctggagctgaagg

SEQ ID NO: 449977 - DNA, 2507 bp, Homo sapiens
catgggttgctggtgcgagtccttaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggtaagtgagtgctgtcagatgcttgtcctggacaattccagagaagggtttgagtttggagttttatctgttgtaaaatggccctgcttttagatttctgtgaaatgctgcctaatatcaagtggcagttccgctaaagtcactttttctgcctctgtggaaactaatactccacagatactttatgtgtttgtacacattatagtgatttgtcagtgtgaagtcatcctgtatggagatgggattgtaaagcccaaatcgtggtgataggagggatggatttggtgaatggagggaatcaaatgataatccagttaaggatactatacctttgacaccagttcaatatttgaaccagtccttctataaattagttctgatgggaggccctggtatggggcctgcactgtcttcaggaactgaaactcaagctccttgatcactggcaacctagaagagtctggtaagatacctcctgaaaatgtacattagtacatttaataattaacctgagaaaggggaatatattatatatatatatatgtcacatgggatgtaatgacaatagaaaaatgaaaccaaaacactagaatatagctggttatacagatcatagtgtgtccggagttggttccttgtggtgggttcttggtctcgcgacttcaagaatgaagccgcagaccttcgctgtgagtgttacagctcttaaagatggtgtgtccggagtttcttccttccagtgggttcgtggtctcgctgacttcaagaatgaagccgcagaccttcacagcaagtgttaccagctcttaaaggtggtgcggacccaaagagtgagcagcagcaagatttatggtgaagaccgaaagaacaaagcttccacagtgtggaagggggacctgagcgggttgccactgctggctagggtggccagcttttattcccttatttgtccctgcccatgtctgctgattggtccattttacagagtgctgattggtgcgtttttacagagtgctgattggtgcatttacaatcctgtagctagacacagagcgctgattggtgcgtttttacagaatgctgattggtgcatttacaatcctctagctagacacagagcactgattggtgcaagtatccacccgacccagaagcccagctggcttcacctcccactagtatcttcttttgtttatgttgtgtattttgtgtatctagatcacgttttagtagcttgtagttccctgttactgggaagcatttcattgcctcccagcttgggagcatccaaagtagaaccatgactgggtcatgaaatgggttaatttggtttctttcattacagggcaaagttctccctgtggactgagaaataaacatattataaaagttacatatgctcatagaatagaaatcaaagagtaaaaagtattgagtgtaaaaaacaagtgtcttttttccccccagtctaactccccagaagtaaccttttttattttttatgttattttttcttaccttcaaggaaggagaaaagtaaccatttttgagttgatgcgtatccttcgcctgagagctatctttgtaatcatcctttttggttcctttttcattttttgctttctttctgtcgtagctgctgtgtaatatagagaatgacacatttgtgggagtttctccccacacagcaaacaggcagtcaattctggagagaggtcaccaggtgggtgtcctctaacccaattcaattccaacattgtgtactcggagatagtgtcagatcccacaggttgagggctctgcccacaagactgcccccaacttgccacaccaattgcaagctccaggctgttttacctgtgcttctggccaaccgattataaattggggttccccacccctttctttggtcaattaatttgctggagcggctc

SEQ ID NO: 449978 - DNA, 1850 bp, Homo sapiens
tactagtacagaacatggcgtcgttagttagccatctcctgtacgagaccccaagactagacatgccttcataaggggattccgatttatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatggggtgggttcgtggtctcgctgacttcaagaatgaagccgcagaccttcacagcaagtgttaccagctcttaaaggtggtgcggacccaaagagtgagcagcagcaagatttatggtgaagaccgaaagaacaaagcttccacagtgtggaagggggacctgagcgggttgccactgctggctagggtggccagcttttattcccttatttgtccctgcccatgtctgctgattggtccattttacagagtgctgattggtgcgtttttacagagtgctgattggtgcatttacaatcctgtagctagacacagagcgctgattggtgcgtttttacagaatgctgattggtgcatttacaatcctctagctagacacagagcactgattggtgcaagtatccacccgacccagaagcccagctggcttcacctcccactagtatcttcttttgtttatgttgtgtattttgtgtatctagatcacgttttagtagcttgtagttccctgttactgggaagcatttcattgcctcccagcttgggagcatccaaagtagaaccatgactgggtcatgaaatgggttaatttggtttctttcattacagggcaaagttctccctgtggactgagaaataaacatattataaaagttacatatgctcatagaatagaaatcaaagagtaaaaagtattgagtgtaaaaaacaagtgtcttttttccccccagtctaactccccagaagtaaccttttttattttttatgttattttttcttaccttcaaggaaggagaaaagtaaccatttttgagttgatgcgtatccttcgcctgagagctatctttgtaatcatcctttttggttcctttttcattttttgctttctttctgtcgtagctgctgtgtaatatagagaaaaaaagtattttttcagctctctcactcaattacaattacacagaaggtttctgtgacacatttgtgggagtttctccccacacagcaaacaggcagtcaattctggagagaggtcaccaggtgggtgtcctctaacccaattcaattccaacattgtgtactcggagatagtgtcagatcccacaggttgagggctctgcccacaagactgcccccaacttgccacaccaattgcaagctccaggctgttttacctgtgcttctggccaaccgattataaattggggttccccacccctttctttggtcaattaatttgctggagcggctc

SEQ ID NO: 449979 - DNA, 186 bp, Homo sapiens
taagaaaacaaaaaaaatttatattggtttaaattacctagagagtggtttggacccttccttctagttgaagaaatataagattttgtgacccatgtctaatggaagtagaacatccacttggtcatgtcttgagtttggttttattctctttgtctagaagattaagattgcggccctgcgcat

SEQ ID NO: 449980 - DNA, 608 bp, Homo sapiens
gggtttcgccatgttggccaggctggtcttgatctcctgacctgaggtgatctgcccacctcggcctcccaaagtgctggaattacaggcatgagccaccgcatccatcctttttttttcttttactcctggcgtgctatgattcaaagttcttttatcctgtggtctcgccctattgttctactggacttttctgcaatagcataatcagagagcaccataagtgccgtgcctgccaatatttaatatatggtcaatatgcttcctttaaaccctcacatacttataccttattgttattttctagggtgtcagatgcctgatacattcaattcatggtttcttataaccctactccacgtctggtaagtgagcaatttaaatgaagtcaccaaatgtatttttttaaacactgctgacttgtaaggtatagccttcaggagggctgattatatgaaatggcagttgttcaggtgttaaaaactgttcctttcattttaataactggtgtcttgaagcacatttttattaaaggtcaaagcataagcccagaaggaaactaatatttgtaggattttttcagagaacacctaacccagtgaacaatg

SEQ ID NO: 449981 - DNA, 2431 bp, Homo sapiens
cagggagagcgtgcccgggcacgacagcctggtgcacagccgagaaaacaacagcgcgtgcgcgtagcgacctctttgcgcctgcgccccccttgccagtctttcgccggcaaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449982 - DNA, 1976 bp, Homo sapiens
catgggttgctggtgcgagtccttaggaaccagactagcatttctcagtgggttccagtatgcagccgattgatacctgtgtctcctacccaaggacagggggacagggctctgtctcgcacttcccagggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449983 - DNA, 1221 bp, Homo sapiens
gctcggtaccctccccgtacgcccaaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacaggtgagcgaccctttccctcccctcccaagtcctggcaacagtgggtcctcctcttgggctttcaggggatcatgagaggtggagttaccaaggaccagcctgagagaattctgaccagatcacatcagcactagacgctgaagaaggagcgccttctgtatgtccaaccatgaactgggccagggagcgggaaatgggaagagagagagaaagaggcatcgagtagtctcctgccctcaggaactttgagtcattcattcactgtgcacctcattgcctactgtgcgcccagtgctatgctagcagctgggcccacagagtcctggcagatatgagcacgtggtgtagtagcagctgcccactgtggaccccttctctacccacttggatttgtttcctgctcctgacttccagcaaaactgggcagcaggcagcatttcacagacagcctcttcctgctagatgctctccacagtcaagtagagtccccccacttcagtttctcacccctctggctccccagggctccccgacatcaaagcttctacgagaaagctccgcagtgggggctgcttacccacatagctgtcctcaagccccggggaattaattccttgacctccctgccctcagatcctgtattgatgggaaactcatacttgatagatgagtgagctgactggcagcgaagaggacatagaggctcttccagggcctcccagtgagtcagcctgcacagctgccctagggccccaagctgtgtgattcatgtgaccactgaggcctcagctgcctcagacagctcaggctgtgccatgagtcacacctttgcttcatggcctggcccctggagctgaagg

SEQ ID NO: 449984 - DNA, 2253 bp, Homo sapiens
catgggttgctggtgcgagtccttaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449985 - DNA, 2475 bp, Homo sapiens
aaaatttgtagaaatagagtcttgctatgttccccaggctgagtcttaaactctggcctcaagcaatcctctcaccttgacctcccaaagtgttggaattacaggtgtgagctattgtgcctggcccaaattcttttatttcttcaggtattcaacagatatttcttgggcatctaccatgtactagacacccttctaggtgctgatcttgggtcttcctggtgagctgatcacggggaagtgggctaagtaaggttggaaagatcctatagtctttactttgaaacagctctgttcagattaaccctgtaagtgctcagtgttgcatagatctgtgtttttattcttcagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449986 - DNA, 2358 bp, Homo sapiens
cagggagagcgtgcccgggcacgacagcctggtgcacagccgagaaaacaacagcgcgtgcgcgtagcgacctctttgcgcctgcgccccccttgccagtctttcgccggcaaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449987 - DNA, 1674 bp, Homo sapiens
gtactgcctgagtcccagctctgcatcacctaactggtggcttggcccctctggaccccctgttctccctctgggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtac

SEQ ID NO: 449988 - DNA, 2561 bp, Homo sapiens
catgggttgctggtgcgagtccttaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggtaagtgagtgctgtcagatgcttgtcctggacaattccagagaagggtttgagtttggagttttatctgttgtaaaatggccctgcttttagatttctgtgaaatgctgcctaatatcaagtggcagttccgctaaagtcactttttctgcctctgtggaaactaatactccacagatactttatgtgtttgtacacattatagtgatttgtcagtgtgaagtcatcctgtatggagatgggattgtaaagcccaaatcgtggtgataggagggatggatttggtgaatggagggaatcaaatgataatccagttaaggatactatacctttgacaccagttcaatatttgaaccagtccttctataaattagttctgatgggaggccctggtatggggcctgcactgtcttcaggaactgaaactcaagctccttgatcactggcaacctagaagagtctggtaagatacctcctgaaaatgtacattagtacatttaataattaacctgagaaaggggaatatattatatatatatatatgtcacatgggatgtaatgacaatagaaaaatgaaaccaaaacactagaatatagctggttatacagatcatagtgtgtccggagttggttccttgtggtgggttcttggtctcgcgacttcaagaatgaagccgcagaccttcgctgtgagtgttacagctcttaaagatggtgtgtccggagtttcttccttccagtgggttcgtggtctcgctgacttcaagaatgaagccgcagaccttcacagcaagtgttaccagctcttaaaggtggtgcggacccaaagagtgagcagcagcaagatttatggtgaagaccgaaagaacaaagcttccacagtgtggaagggggacctgagcgggttgccactgctggctagggtggccagcttttattcccttatttgtccctgcccatgtctgctgattggtccattttacagagtgctgattggtgcgtttttacagagtgctgattggtgcatttacaatcctgtagctagacacagagcgctgattggtgcgtttttacagaatgctgattggtgcatttacaatcctctagctagacacagagcactgattggtgcaagtatccacccgacccagaagcccagctggcttcacctcccactagtatcttcttttgtttatgttgtgtattttgtgtatctagatcacgttttagtagcttgtagttccctgttactgggaagcatttcattgcctcccagcttgggagcatccaaagtagaaccatgactgggtcatgaaatgggttaatttggtttctttcattacagggcaaagttctccctgtggactgagaaataaacatattataaaagttacatatgctcatagaatagaaatcaaagagtaaaaagtattgagtgtaaaaaacaagtgtcttttttccccccagtctaactccccagaagtaaccttttttattttttatgttattttttcttaccttcaaggaaggagaaaagtaaccatttttgagttgatgcgtatccttcgcctgagagctatctttgtaatcatcctttttggttcctttttcattttttgctttctttctgtcgtagctgctgtgtaatatagagaaaaaaagtattttttcagctctctcactcaattacaattacacagaaggtttctgtgacacatttgtgggagtttctccccacacagcaaacaggcagtcaattctggagagaggtcaccaggtgggtgtcctctaacccaattcaattccaacattgtgtactcggagatagtgtcagatcccacaggttgagggctctgcccacaagactgcccccaacttgccacaccaattgcaagctccaggctgttttacctgtgcttctggccaaccgattataaattggggttccccacccctttctttggtcaattaatttgctggagcggctc

SEQ ID NO: 449989 - DNA, 1868 bp, Homo sapiens
catgggttgctggtgcgagtccttaggaaccagactagcatttctcagtgggttccagtatgcagccgattgatacctgtgtctcctacccaaggacagggggacagggctctgtctcgcacttcccagtggccccagatgagccagtcccaagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggaactgaaactcaagctccttgatcactggcaacctagaagagtctgtgggttcgtggtctcgctgacttcaagaatgaagccgcagaccttcacagcaagtgttaccagctcttaaaggtggtgcggacccaaagagtgagcagcagcaagatttatggtgaagaccgaaagaacaaagcttccacagtgtggaagggggacctgagcgggttgccactgctggctagggtggccagcttttattcccttatttgtccctgcccatgtctgctgattggtccattttacagagtgctgattggtgcgtttttacagagtgctgattggtgcatttacaatcctgtagctagacacagagcgctgattggtgcgtttttacagaatgctgattggtgcatttacaatcctctagctagacacagagcactgattggtgcaagtatccacccgacccagaagcccagctggcttcacctcccactagtatcttcttttgtttatgttgtgtattttgtgtatctagatcacgttttagtagcttgtagttccctgttactgggaagcatttcattgcctcccagcttgggagcatccaaagtagaaccatgactgggtcatgaaatgggttaatttggtttctttcattacagggcaaagttctccctgtggactgagaaataaacatattataaaagttacatatgctcatagaatagaaatcaaagagtaaaaagtattgagtgtaaaaaacaagtgtcttttttccccccagtctaactccccagaagtaaccttttttattttttatgttattttttcttaccttcaaggaaggagaaaagtaaccatttttgagttgatgcgtatccttcgcctgagagctatctttgtaatcatcctttttggttcctttttcattttttgctttctttctgtcgtagctgctgtgtaatatagagaaaaaaagtattttttcagctctctcactcaattacaattacacagaaggtttctgtgacacatttgtgggagtttctccccacacagcaaacaggcagtcaattctggagagaggtcaccaggtgggtgtcctctaacccaattcaattccaacattgtgtactcggagatagtgtcagatcccacaggttgagggctctgcccacaagactgcccccaacttgccacaccaattgcaagctccaggctgttttacctgtgcttctggccaaccgattataaattggggttccccacccctttctttggtcaattaatttgctggagcggctc

SEQ ID NO: 449990 - DNA, 1047 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaa

SEQ ID NO: 449991 - DNA, 597 bp, Homo sapiens
  misc_feature (283)..(283): n is a, c, g, or t
cgcagtcttctcccatcagctcatccacatagtctcgtttgagttcctcaggaacatcactgtcactgtcatactcttgataggcactcttttcttgttcatcagattcatacccattagaagctaagacatcttctgtttcttcatctttgtggttggcctgaatttcaaatggattcccaccactacagtactgctcaaacaaggtcactgtttttgaagaagttgagactggctgtttactaggtgaaactgatgggacgaagatgcgccagtcttctcncttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaa

SEQ ID NO: 449992 - DNA, 4207 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 449993 - DNA, 4337 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggtaggttccaggctgagcggcgggaggcagtccccggcagaggcgaccccagggagccaggccccatacggacgggcctctccgtggaggagaactcgcttcgtatttgtaccggttccgagttttccaggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 449994 - DNA, 4510 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaaaaaaaaaaaaaacaaaaaaaaaaaaaaaaaaaaaaaaaaaaaaaaaaaaaaaaaataaaatacctttgcggcccccttggcccaaggggattttaacttgggcaaggttattgctgccgcccgaatttggggttaattggccaattccgccttatggggggcggttataaattccatggcccggggttttacagggcggggctgggaaaacccctgggggtacccaacttaattgcgctgggagaaaatcccctttttccaggttggggaaaaagcgaagaggcccggaccggtggcctctcc

SEQ ID NO: 449995 - DNA, 2590 bp, Homo sapiens
gtcggtacctacttttccacagggagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 449996 - DNA, 2430 bp, Homo sapiens
cggacgcgtgggtcgacccacgcgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 449997 - DNA, 4271 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaacaaagaggtctgcattatgcttgcatgtcaaaaacattaaaaatcctataatcttcaaaaaaat

SEQ ID NO: 449998 - DNA, 4266 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaaattcaatcctaattcaccgacctcttgctctctccggttaaaaaattctcaaggggggg

SEQ ID NO: 449999 - DNA, 4397 bp, Homo sapiens
  misc_feature (4212)..(4212): n is a, c, g, or t
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaatctgntttttttttttttttttaagcataatacaaaataaatttttttaattgggcaaacttccagatgggaatttcaaagaacaaagtgcttgagatgcaaagattagttccagttgctttgaccaaattttttagacaagtatttcattttaaagggctctcgttggagaaaaacctcaaattgggcc

SEQ ID NO: 450000 - DNA, 1743 bp, Homo sapiens
  misc_feature (13)..(13): n is a, c, g, or t
  misc_feature (54)..(54): n is a, c, g, or t
gaccaggtcctgnctgctgcctgctggtcaggcttctagtttcagggggaactntggccccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450001 - DNA, 1804 bp, Homo sapiens
cttaatatagcttgacgaatcctacgcagcttgaagatttctaagatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450002 - DNA, 1408 bp, Homo sapiens
ccagacaacttatattcaaaagctcatctttcaaaaggttccaccttgcccgtttatttaaacagtcacgaccttccttattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450003 - DNA, 3235 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctagaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450004 - DNA, 2076 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450005 - DNA, 4153 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatcttgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450006 - DNA, 3861 bp, Homo sapiens
  misc_feature (3717)..(3717): n is a, c, g, or t
  misc_feature (3720)..(3720): n is a, c, g, or t
  misc_feature (3732)..(3732): n is a, c, g, or t
  misc_feature (3736)..(3736): n is a, c, g, or t
  misc_feature (3740)..(3740): n is a, c, g, or t
  misc_feature (3745)..(3745): n is a, c, g, or t
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaagcacgtttgatnatntgtgtgacatgnatanttgngtganccactttggctttgatgatgtaggagtaatatggggtaaaagtccctataattttggattacgtaaagtgtggggaggaaatagaagtcaaaggtatgaagtgtgattgattaagt

SEQ ID NO: 450007 - DNA, 944 bp, Homo sapiens
cacttctgacattcttgtaatcaccgattcatacacaatctcctgatgtaatccattgactgcttcttttagaaaggcgaaactgaaacctgcttgaaggttaaataaaaactctgtgcttatgcttaaaaagtgcagtggcgggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450008 - DNA, 891 bp, Homo sapiens
aagcagttaatacagactcagagtaaataacttgcctaagggtgatacaggatgtaggtgctacaatcaagattcaaagtccatgctttgggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450009 - DNA, 825 bp, Homo sapiens
tgttaagaatatagcctatttttgccaagtgcagtgtctcacaccatgttaatccgagacactttgggacgctgagccagacggatcacttcaagtcctgaattggaaaacccgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450010 - DNA, 3645 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcgattacaggcataagccatcacgcctggccaaatcatggtttagaaaagggagatggtcaaatataattgttatgactgccatagtacctactatgtcccagataatttgcctaggtttttaaccctcacaacacatccctaaaacattgtacagatgcaaatgcagaggcacgaagaggcttaaaacattcccaaagtcacatagttactataaagccagtaactggctctatgtctaaa

SEQ ID NO: 450011 - DNA, 3159 bp, Homo sapiens
  misc_feature (3122)..(3122): n is a, c, g, or t
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagtcagcagatctgcaaacncttgttagttcaataacaggtaccgagctcgattcta

SEQ ID NO: 450012 - DNA, 1370 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaaaaaaaaaaaaaaaaaaaaaaaaaaaaaaaaaacaaaaaaaaaaaaaaaaaaaaaaaaaaaaaaaaaaaaaaaaaataaaatacctttgcggcccccttggcccaaggggattttaacttgggcaaggttattgctgccgcccgaatttggggttaattggccaattccgccttatggggggcggttataaattccatggcccggggttttacagggcggggctgggaaaacccctgggggtacccaacttaattgcgctgggagaaaatcccctttttccaggttggggaaaaagcgaagaggcccggaccggtggcctctcc

SEQ ID NO: 450013 - DNA, 2051 bp, Homo sapiens
  misc_feature (1442)..(1442): n is a, c, g, or t
  misc_feature (1444)..(1444): n is a, c, g, or t
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggtaggttccaggctgagcggcgggaggcagtccccggcagaggcgaccccagggagccaggccccatacggacgggcctctccgtggaggagaactcgcttcgtatttgtaccggttccgagttttccaggcacgatagtctctcttttaaacacatggtctacctcattgtagaaggagtgcctcgatgggtttgaacacacttctgtcatctcagggaacttggggtcctgcgaaggagcttgccttactgttgtgagccacattccgttacacatattgccagcactggtgaattgtagggcctgaaaagaaagctctactgtgtcactcgttttttttgcaaattgaaattgttcttgttgtataatgtgctttggggaaatgtttggtctctcaggtaggtgtgccagccgtttgcaggagggctgagagcgcctgtccactggtggccagacatcatcgggtccgcaggtgtctctgagtgtcagggtcacctcctgatagaagtgggagtggtgtcttactgccaggtcacactgaaggtgggagacaggaggacactactccgtgctaggaaccatggtccttgtcatcttcctgagagcaaacggggtcgggactccagcctaggacttggagactccctgcatccccagctaccctgcaggtgaaacttcactgagcccacttgacttcaggtgggagaggaggaggcacaccgttgtggtgtgcgttaccaaaaaagcagtaacctaactgtggaacagttcaggatctttagacttgatacttttcttgatttcccttaggggtcaaagttcacaaggaaaatagccctttagtgggaaactgaaacaggcttgtttttatttactatttactcatatttgtaatgcaattaaaatatatgttgttaactttttttttttttctcaagagctcggttgataaaaccaggggtatgtggactttttgagtctgtgccttttgggggtgtgtatgggaatgttatgttttaacgttttttacaaaatagtattgtctttttantntattcgttagtggtttgcacaaggaagataatcgatagtcatgttttttagactctctgtattgcttggtaagctacgtagtaaaaaatgtttacttttccttaaatgttttgaatttcggggttatgaaatttgttgagtaatttttagacagtcacatcttgttgactggaggcatctagtggaaaaatgcagtatttcagcctgattgtgtttgaagtaaatgattaaaagaggaggaagttaccacattctggaagatttacttgagacagacgaaccttgaattacgggaaaaggccccgtgatttaggaaataacaaatttgggaaacatgtaatggggagagactggggaataccccagttgtgaaagtacttcctgtaaggcaacatctgacaccaggaacctttctcttcagtattttaaaaacaacttaatttcagtcctttacttgtggaatcagagccttacttatgtaatacaacccactggaaaaaagctttttattgtattgtactatattgtttataagtgattgagtacctgcagagctttcttttacttaaacatattttaaaaattattaaaaagattttcatgtttg

SEQ ID NO: 450014 - DNA, 917 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450015 - DNA, 737 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaa

SEQ ID NO: 450016 - DNA, 690 bp, Homo sapiens
gaatgagattgttacaaagggtaattttgtgtgagtagaataataaaagttgaaattgagaagatgcaatgttttagactgaaactgatggttggtttgttttccccttctttctaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaa

SEQ ID NO: 450017 - DNA, 819 bp, Homo sapiens
cggacgcgtgggtcgacccacgcagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaaaaaaaaaaaaaaaaaaaaaaaaaaaaaaaaaaaagggggggggggtaaaaaattccctgagagggggccaaaatttagggaacccaagttctgtttgaacaagatctggtgccccaatatggggagccagttataaaaaacgagagacagcggagacgaaacttaaacaaccgccgacgacgtggcaaaaccgcggcaccctcgacacctttgcagaagaaacccatacctggcggggggcacaattatggacgcacatccccacaagtatttaccgccaggcaacaaaacatataacagtactactatggtgaaaccacgatattatcgcactaaagttggtcagaaacattgaaaattag

SEQ ID NO: 450018 - DNA, 4089 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450019 - DNA, 4090 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450020 - DNA, 4287 bp, Homo sapiens
  misc_feature (4212)..(4213): n is a, c, g, or t
  misc_feature (4224)..(4225): n is a, c, g, or t
  misc_feature (4231)..(4231): n is a, c, g, or t
  misc_feature (4241)..(4241): n is a, c, g, or t
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaactccnnaaagaaaaaanntttttnagtaatttcnttttttttctcctcgagggggggccccgtacccaattcgccctttt

SEQ ID NO: 450021 - DNA, 4383 bp, Homo sapiens
  misc_feature (4223)..(4223): n is a, c, g, or t
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaattctcctcccaaaaanctcacatttatttttttgcaacgcaaatagttgccaaccaacaaaacttaagtttccagaatgttatatttttaaaaaaggataaccggtggaggaggaaaatttccaaaaaggcgatagcccctggttaaaattgattggaatccccccggggggaaaa

SEQ ID NO: 450022 - DNA, 3186 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtggaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450023 - DNA, 2959 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450024 - DNA, 3940 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgcttggtgtggaatccaattttggcctcttggatgaatcatggctaaggggatgagtctaggcgctttaaaatatacagctaggatctgtttggttataccctaaaaggtccggacccgacggggaccttggttcatggctccaaaaccaaagctcgtcgaccacgtg

SEQ ID NO: 450025 - DNA, 3612 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgtttttttttttcttttttttgggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctacttttggtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggctgagccactggcacctggcctatataggcttttttcttaaaacctatttaggtaatgtttttcccaagtctaatgtcataatcgttagatatactgccgcaacagttatcatatgtctagcatgccttgtcaagtgtgcgaatattagagggatctacacgcatggctagggctcgacaagattgagaaataaaatcaaagatag

SEQ ID NO: 450026 - DNA, 1034 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450027 - DNA, 869 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 450028 - DNA, 1064 bp, Homo sapiens
ggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttatcgagctcgataagggccaaagtcaaaccgcacatcaggatctctcacacccttccaattttgccatctaccagcacttagctaaacccatctcccatctcttccaccatgaattcactctttcatagtccagagttatattggcactcacccatgcataattgttttgtcaaaccttttaggggagaggtgtatttaaagaattatgaaaatactgacaagggaccagcccaattataccggagaggtttagagacatccacagaggatgagtcaagagtgttggattgggggttggaagacaagataggtggagagtcgagcactaaatgcaaatagatgtgatgtacattatgatttgtgcctgaaaaatagctgagaaatcattgttgctgttgcatagattgtatagggactggggtagttacagcatgtgagtgtgactagtta

SEQ ID NO: 450029 - DNA, 1284 bp, Homo sapiens
tgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatctagtgctgtaattgtacgggttttttccccctcactcagggtgagcatcatcaatatcatggttctaattatatgcccttcagtttgataatgaagctcagctctttgctgataatgaggtttaacattgagataactggtttttaatctactttaagcagacttgctgtcaaacatctactgaaatatatttcactctaactactagcctgaggtagaggttatatagggacaacttcatctcatccaaacaaatgaactgcttcctacagtcggggtgctgcctttaacatagtcccaatatttgaatggcacacatggataaaaggatgctgtcagtcaggggctgcttgtgtgtcccaattcctaataggaataataggcatatctatgacctattcactgtgccccttggttggggaaggttttcagctgttcttaacttggcttgggcgttggaatcacctggggagctttacaa

SEQ ID NO: 450030 - DNA, 799 bp, Homo sapiens
tgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttat

SEQ ID NO: 450031 - DNA, 1161 bp, Homo sapiens
tgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataaaaaaaaaaaaaaaaaaaaaaaaaaaaaaaaaaaaaaaaaaaaaaaggggggggggggaaaaaattccccggggggggccaatttagcggataccacgcctttgtgtaacaaaagcggggcccccaacaagaaggggggctataattatagctgcagcagcgggggcgcgttttaaaacaagtgtttggggggaaaacatggtctaatggtgatttcttgtggaaagaacccacatcgggggggggacatatgggggaacactaacagaaggaattaaagttcctgggaaattaaaactcaggtgttcgagtgaaccaacgcatattttcggctagaaattggttcagatttgttgaaaat

SEQ ID NO: 450032 - DNA, 1392 bp, Homo sapiens
tgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcggttagtgctggcgcgggagcaatagcgagggtcgtgagctttggccgctgagggcacaaggaattagtaacaggaactgaggcgatagaattggcgcatgcgtacgagacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatctagtgctgtaattgtacgggttttttccccctcactcagggtgagcatcatcaatatcatggttctaattatatgcccttcagtttgataatgaagctcagctctttgctgataatgaggtttaacattgagataactggtttttaatctactttaagcagacttgctgtcaaacatctactgaaatatatttcactctaactactagcctgaggtagaggttatatagggacaacttcatctcatccaaacaaatgaactgcttcctacagtcggggtgctgcctttaacatagtcccaatatttgaatggcacacatggataaaaggatgctgtcagtcaggggctgcttgtgtgtcccaattcctaataggaataataggcatatctatgacctattcactgtgccccttggttggggaaggttttcagctgttcttaacttggcttgggcgttggaatcacctggggagctttacaa

SEQ ID NO: 450033 - DNA, 1204 bp, Homo sapiens
gggtgtgatgggagcacacaagacttgctaaggagagggaactggcgacccgaaggctgcggcttcctagctacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatctagtgctgtaattgtacgggttttttccccctcactcagggtgagcatcatcaatatcatggttctaattatatgcccttcagtttgataatgaagctcagctctttgctgataatgaggtttaacattgagataactggtttttaatctactttaagcagacttgctgtcaaacatctactgaaatatatttcactctaactactagcctgaggtagaggttatatagggacaacttcatctcatccaaacaaatgaactgcttcctacagtcggggtgctgcctttaacatagtcccaatatttgaatggcacacatggataaaaggatgctgtcagtcaggggctgcttgtgtgtcccaattcctaataggaataataggcatatctatgacctattcactgtgccccttggttggggaaggttttcagctgttcttaacttggcttgggcgttggaatcacctggggagctttacaa

SEQ ID NO: 450034 - DNA, 899 bp, Homo sapiens
  misc_feature (801)..(801): n is a, c, g, or t
tgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttatcnaaaagaaaaagatagaacaaaaaaaagggggaatttggggggaaaaaagaaaaaggaaggagatgtctaacttttaaaaagggaaaaggggccaaagg

SEQ ID NO: 450035 - DNA, 888 bp, Homo sapiens
tgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccaggtcagtgcactggctaaaaacaaccatatagaactgctacactgagagaatgaaagaataagattgtataacccaaatagggagataggaaatggtttactggttccttccccctccagtcgtgggggatttttttaaaaaaaaactagtgaccaaaaataagactaaaatatctgggaagttcagagacaacctgtcactgaaaaacctcctgtaatctttcattcaatcagagggtattctttttaaggccacatatagcctgatcatagcccctgcctcattctccatcgaaaacattcttggatgtgttctaaataagcaaaggaaagtatatttattgataagacaccagacacccagctgccaggcaaaactaataagggacaccctggggctgtataaacatagcaaaagaactgatattaacaattctgtacttggcagacagtccagacttctgggtctgcttctaaggccatatgcttaagtctttatttagttataaagatctgagtgggtgatagctggggaggtggtagtggaatacactataggttgtacatagaatggtgtgagcttgtctcttagatttccctcactctttc

SEQ ID NO: 450036 - DNA, 1280 bp, Homo sapiens
  misc_feature (53)..(53): n is a, c, g, or t
  misc_feature (57)..(57): n is a, c, g, or t
gagtcaccggtaaggaaagatatcaaggcgtatgtatgttcgagggatataantatncaggaggctttcagaataaaagtaaatcatatatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatctagtgctgtaattgtacgggttttttccccctcactcagggtgagcatcatcaatatcatggttctaattatatgcccttcagtttgataatgaagctcagctctttgctgataatgaggtttaacattgagataactggtttttaatctactttaagcagacttgctgtcaaacatctactgaaatatatttcactctaactactagcctgaggtagaggttatatagggacaacttcatctcatccaaacaaatgaactgcttcctacagtcggggtgctgcctttaacatagtcccaatatttgaatggcacacatggataaaaggatgctgtcagtcaggggctgcttgtgtgtcccaattcctaataggaataataggcatatctatgacctattcactgtgccccttggttggggaaggttttcagctgttcttaacttggcttgggcgttggaatcacctggggagctttacaa

SEQ ID NO: 450037 - DNA, 1131 bp, Homo sapiens
tgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttatgaaaaaaaacatacacacacaagacacaaactctgtgggcgcagcactagggcctcagaaaaggttttacacaacctctccgttggcagaccggagccccagaagggtaatgcaacactgggggccaacaaggggggaccccagagggaggatcccgtgggcacaaaaactacaggcagtggggatgtctcccgcattaaaaaacaacggcgcggggggggacaccccgacgagtctgttgtagaacacaatccccaagaggagaggtcccagaggagcacacacggaggtcctcacaacaggggaggtcacagagagaagcggcattcata

SEQ ID NO: 450038 - DNA, 1208 bp, Homo sapiens
ttcacagtaatcttgtcgaatccagtgggagaacgtagcaaaagcggagctggaagtttcctggcgtccctaacagacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatctagtgctgtaattgtacgggttttttccccctcactcagggtgagcatcatcaatatcatggttctaattatatgcccttcagtttgataatgaagctcagctctttgctgataatgaggtttaacattgagataactggtttttaatctactttaagcagacttgctgtcaaacatctactgaaatatatttcactctaactactagcctgaggtagaggttatatagggacaacttcatctcatccaaacaaatgaactgcttcctacagtcggggtgctgcctttaacatagtcccaatatttgaatggcacacatggataaaaggatgctgtcagtcaggggctgcttgtgtgtcccaattcctaataggaataataggcatatctatgacctattcactgtgccccttggttggggaaggttttcagctgttcttaacttggcttgggcgttggaatcacctggggagctttacaa

SEQ ID NO: 450039 - DNA, 907 bp, Homo sapiens
tgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcggttagtgctggcgcgggagcaatagcgagggtcgtgagctttggccgctgagggcacaaggaattagtaacaggaactgaggcgatagaattggcgcatgcgtacgagacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttat

SEQ ID NO: 450040 - DNA, 499 bp, Homo sapiens
  misc_feature (23)..(23): n is a, c, g, or t
  misc_feature (442)..(442): n is a, c, g, or t
  misc_feature (448)..(448): n is a, c, g, or t
  misc_feature (451)..(451): n is a, c, g, or t
  misc_feature (455)..(455): n is a, c, g, or t
  misc_feature (457)..(457): n is a, c, g, or t
  misc_feature (462)..(462): n is a, c, g, or t
  misc_feature (465)..(465): n is a, c, g, or t
gtatggttcccgtagtggacaangcgctacgcggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtgtctagctcnaggttngtntgangnatagnganaagcgcgtagcgcattgtccatagggtaccgggc

SEQ ID NO: 450041 - DNA, 134 bp, Homo sapiens
gacctgcaaactttttctgtaaaggaccagatagtaagtattttatgctttgtgagccatacagtttttgttgcaactagtcaactctcaactccactgtggacagcatgtaaatggatgggagtggctgcttt

SEQ ID NO: 450042 - DNA, 1548 bp, Homo sapiens
gccgtttctgccgcgtccaccacaacctctgctgtatcagagggggccttcgccgccgccgcccccaccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcagtcagggatgttggaagctggagtagacaggattatttctcaggtggtggatccaaaacttaaccacatcttcaggccacaaatagaacgagcaattcatgagttcctggcggcccagaaaaaagcagctgtgccagcaccccctccagagcccgaaggccaggaccctccagctccatctcaggacacttcctaagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttcataataaaattatttgatactttta

SEQ ID NO: 450043 - DNA, 1351 bp, Homo sapiens
gccgtttctgccgcgtccaccacaacctctgctgtatcagagggggccttcgccgccgccgcccccaccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcaaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttcataataaaattatttgatactttta

SEQ ID NO: 450044 - DNA, 1380 bp, Homo sapiens
gactggtgtcatggccgttcactgaggtgcagcccgccgcacgacggtttgccagcttaccaaaacctgaggcagaaagtggataattttgtgtcaacacatctggacaagcaggaatggaatcctacgatgaacaaaaaccagttgcgaaatggtctgaggcagagtgtggttcagttgggtgattgtgggtgagattgtgcagtaggaataacagctgctggttgagaattacccctcaaaagtgaaaatagcgtgagctgtatatggtaagtggattgacctctaaactccctagaagggctgtagctttgaaggtggacatttattgggctcgcacgtgacacttattggggctaaagatgaatcccgaagaactaaataacagaatgatctgtttgtctccacaaggtcagggatgttggaagctggagtagacaggattatttctcaggtggtggatccaaaacttaaccacatcttcaggccacaaatagaacgagcaattcatgagttcctggcggcccagaaaaaagcagctgtgccagcaccccctccagagcccgaaggccaggaccctccagctccatctcaggacacttcctaagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttcataataaaattatttgatactttta

SEQ ID NO: 450045 - DNA, 1562 bp, Homo sapiens
gccgtttctgccgcgtccaccacaacctctgctgtatcagagggggccttcgccgccgccgcccccaccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcagtcagggatgttggaagctggagtagacaggattatttctcaggtggtggatccaaaacttaaccacatcttcaggccacaaatagaacgagcaattcatgagttcctggcggcccagaaaaaagcagctgtgccagcaccccctccagagcccgaaggccaggaccctccagctccatctcaggacacttcctaagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttattatgaaagataagccatttattgaccattcacttttctaaaaaaaactagttctagatcgcgagcggccgct

SEQ ID NO: 450046 - DNA, 1783 bp, Homo sapiens
gccgtttctgccgcgtccaccacaacctctgctgtatcagagggggccttcgccgccgccgcccccaccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcagttgggtgattgtgggtgagattgtgcagtaggaataacagctgctggttgagaattacccctcaaaagtgaaaatagcgtgagctgtatatggtaagtggattgacctctaaactccctagaagggctgtagctttgaaggtggacatttattgggctcgcacgtgacacttattggggctaaagatgaatcccgaagaactaaataacagaatgatctgtttgtctccacaaggtcagggatgttggaagctggagtagacaggattatttctcaggtggtggatccaaaacttaaccacatcttcaggccacaaatagaacgagcaattcatgagttcctggcggcccagaaaaaagcagctgtgccagcaccccctccagagcccgaaggccaggaccctccagctccatctcaggacacttcctaagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttcataataaaattatttgatactttta

SEQ ID NO: 450047 - DNA, 1836 bp, Homo sapiens
gccgtttctgccgcgtccaccacaacctctgctgtatcagagggggccttcgccgccgccgcccccaccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcagtcagggatgttggaagctggagtagacaggattatttctcaggtggtggatccaaaacttaaccacatcttcaggccacaaatagaacgagcaattcatgagttcctggcggcccagaaaaaagcagctgtgccagcaccccctccagagcccgaaggccaggaccctccagctccatctcaggacacttcctaagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttcataataaaattatttgatacttttaaaaaaaaaaaaaaaaaaaaaaaaaaaaaatttgtgggcggccagcgggccctggaaaaaagattcttaagaacacatgcgcggtgggccgcgggaccacggtagttgtagtgtgcacactggggcataagggtaccaaaggaagaccccggggcatggaacaagttgtgggggtttccccacccataaaaaaaccgcgggggacacagacgtctgtgacaaatcccgagggagtcgagggcatacggatctacaacggggcccaaggagcgataaatacggcgggggg

SEQ ID NO: 450048 - DNA, 892 bp, Homo sapiens
gccgtttctgccgcgtccaccacaacctctgctgtatcagagggggccttcgccgccgccgcccccaccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcaaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcagacatacacccctgaggctcgctatatcctacgcatcccgcaacacaaactcgggggggcccctgtccccatatggccctatgtggcgccgcgtgacattccactcgccgcggtctaccactgcgtggatgggtgtggtgtcagaggatcaggcagcgt

SEQ ID NO: 450049 - DNA, 444 bp, Homo sapiens
agtataagaatgctaaagtcacagtactgaggatttaaaaaatgtggtttctagtttagcagtgggccgaagaagatacttgaggatgttaaagactcagactgatttgacatgcactgacctctcctatacccctcactggagaagggcacagatcacagacctcagaggataagattcccacattcctgatgtggaaatgttctcccaaacaggggtgattccatgccaccttcatgatttttactctgtccttgtattatccatattgtgtactcattttttaaaagtctgacataaaaataacttaaaaatgaaaactttatatcatgtccttaaaaggaggtatcacttgccataaatactaggtaactataaaagttatatgtaatggaactaaataaagttgtggactctagccagatactggtccaacattgacta

SEQ ID NO: 450050 - DNA, 3969 bp, Homo sapiens
tggagaatccggttggggtaggagctaaatctcaggaccacttgctctatatatgagtgccaagataatctagagcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacgatgaaggtacaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaa

SEQ ID NO: 450051 - DNA, 2182 bp, Homo sapiens
cccgtgccgattcttgcaaagatggattgtcaagatgaaggtacaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaa

SEQ ID NO: 450052 - DNA, 1669 bp, Homo sapiens
cccccatgccgcccgcgggaattcgattcagccttaccccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaa

SEQ ID NO: 450053 - DNA, 1576 bp, Homo sapiens
ctgcccacgaagtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaa

SEQ ID NO: 450054 - DNA, 1328 bp, Homo sapiens
tgatctagaggagcgtttctctgatcgctcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaa

SEQ ID NO: 450055 - DNA, 793 bp, Homo sapiens
tgctgcggtgatctagaggatccgtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaa

SEQ ID NO: 450056 - DNA, 2901 bp, Homo sapiens
tggagaatccggttggggtaggagctaaatctcaggaccacttgctctatatatgagtgccaagataatctagagcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtacaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaatt

SEQ ID NO: 450057 - DNA, 2807 bp, Homo sapiens
tggagaatccggttggggtaggagctaaatctcaggaccacttgctctatatatgagtgccaagataatctagagcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtacaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaagttcagagccaggcctggctctgaacttaggcctggctctggggatgatggagaacgactcctcggcctaggagtctgaggcaaagctttcggttctggggaagaatcacattcgcttctccctctagatggcgttctaggtatatctttcattccaggagaggacccagacaggctgtgcctcgagggagtcccagacccatctctaagtcctggagaagacccagacctgcttctccttgatggagttctgggtaaaccatctttcatttcaggagaagatgcagaactacttctttctctcgagggtgtactgggtacagcatcaagcacaggtgaagagatgctctgatttgaagacatccctgccttttccactgcatctggggataactcagaactgctgtgtccagaggatcttgtcgattgttctttcatgtctagagatggatctgtgtccagctgattaagaaacggtccattcaaatctctttaacctcagaagaaatccagta

SEQ ID NO: 450058 - DNA, 949 bp, Homo sapiens
tggagaatccggttggggtaggagctaaatctcaggaccacttgctctatatatgagtgccaagataatctagagcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaaggttagtataaaatgtcagtta

SEQ ID NO: 450059 - DNA, 4088 bp, Homo sapiens
tggagaatccggttggggtaggagctaaatctcaggaccacttgctctatatatgagtgccaagataatctagagcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtacaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaa

SEQ ID NO: 450060 - DNA, 2496 bp, Homo sapiens
  misc_feature (13)..(13): n is a, c, g, or t
  misc_feature (26)..(26): n is a, c, g, or t
ttcgcctactacnactatgctgcganaaagacgacagaagatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtacaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaa

SEQ ID NO: 450061 - DNA, 4289 bp, Homo sapiens
tggagaatccggttggggtaggagctaaatctcaggaccacttgctctatatatgagtgccaagataatctagagcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtacaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaaaaaaaaaaaaaaaaaacaaaaaaaaaacgtggggggggcaggggccggaaaaagtttaaacccccggtggggccccggcccaggagagagaacgggccaagggggcccaggagagccgggcggaaacggggggggtccccaaaaaagccgggaacggggcggaacaccccaagggccgggccgggccacaggccccggcac

SEQ ID NO: 450062 - DNA, 4034 bp, Homo sapiens
tggagaatccggttggggtaggagctaaatctcaggaccacttgctctatatatgagtgccaagataatctagagcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtacaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaa

SEQ ID NO: 450063 - DNA, 2930 bp, Homo sapiens
tggagaatccggttggggtaggagctaaatctcaggaccacttgctctatatatgagtgccaagataatctagagcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtacaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgtttagcagtgggccgaagaagatacttgaggatgttaaagactcagactgatttgacatgcactgacctctcctatacccctcactggagaagggcacagatcacagacctcagaggataagattcccacattcctgatgtggaaatgttctcccaaacaggggtgattccatgccaccttcatgatttttactctgtccttgtattatccatattgtgtactcattttttaaaagtctgacataaaaataacttaaaaatgaaaactttatatcatgtccttaaaaggaggtatcacttgccataaatactaggtaactataaaagttatatgtaatggaactaaataaagttgtggactctagccagatactggtccaacattgacta

SEQ ID NO: 450064 - DNA, 868 bp, Homo sapiens
tggagaatccggttggggtaggagctaaatctcaggaccacttgctctatatatgagtgccaagataatctagagcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggattcaattcaaaaccagctgttgccatagatacgaaagagccatgtgtttcccaaatatgttcttagatggaaagaatgttggattttctgagccattagttttagtgattataccaagcaggggaagctggataatgtatggtgtgtattaggatgctgtgctcttcatttgaactctctcaaagaagtgtttaagtgtaatgcattttaagaatttgtagagttctgtaataaacttttttccccacc

SEQ ID NO: 450065 - DNA, 3433 bp, Homo sapiens
tgctctgcccgttgctcagcaagttacttggggttccagtttgataagaaaagacttcctgtggaggaatctgaagggaaggaggaggagctggcccattcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcgcagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtgtggacacagctgctccgggccttggaggagagggccattccaatctggtgggtgctggtgggtgtgctgggtggcctgctgctgctcaccatcctggtcctggccatgtggaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctgat

SEQ ID NO: 450066 - DNA, 1104 bp, Homo sapiens
  misc_feature (1)..(2): n is a, c, g, or t
  misc_feature (4)..(4): n is a, c, g, or t
  misc_feature (8)..(8): n is a, c, g, or t
  misc_feature (10)..(10): n is a, c, g, or t
  misc_feature (12)..(15): n is a, c, g, or t
  misc_feature (17)..(17): n is a, c, g, or t
  misc_feature (19)..(20): n is a, c, g, or t
  misc_feature (23)..(24): n is a, c, g, or t
  misc_feature (26)..(26): n is a, c, g, or t
  misc_feature (36)..(36): n is a, c, g, or t
  misc_feature (50)..(50): n is a, c, g, or t
  misc_feature (61)..(61): n is a, c, g, or t
  misc_feature (68)..(69): n is a, c, g, or t
  misc_feature (80)..(80): n is a, c, g, or t
  misc_feature (99)..(99): n is a, c, g, or t
  misc_feature (107)..(107): n is a, c, g, or t
nnanaatntnannnngntnnggnncngtggctcacncctgtaatcccagnactttgggagnccaaggnnggcagatcacntgaggtcaggagttcgagntcagcctngccgaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcgtttgaggaagaagcaaagtgtagtagttagaatggtgatttctgagcaagaagatgggggctctgtattcctggccaagtagcttggcttctctgggtctcagtttgctgccaaagcaaacgaggataatactgatcctacctgtaataggaccattgaaaggatttcacaggatgaggtttatgaaaatactttatagttaataattctacatcatatacctgaaatttgctaagagagaaaaatcttaaaacgttctcaccacaaaagataactatgtgaggtgatacatacgctaattagcttgattgtggtaatcctttcacaatgtatacatataccaaaacatcatattgcacactgtgaatatatacaatttatttgtcaattatacctcaatacagctggaaatacataaattttcatgcactgtgtaaatatgagagatgg

SEQ ID NO: 450067 - DNA, 563 bp, Homo sapiens
gctgaggcaggagaatcgtttgaacctgagaggcagaggttgtggtgagccgagatcatgccattgcactccagcctgggcaacgagagcgaaactctgtctcaaaaaaaataaaaactcaggggagaaaaaacaaaaacccaacaattcgttccatgcattatctctaaatgtcaaaaggcatccatttgtgagtacagtgggcttcatgttctgcgctggtccagggaggtgctcatagctagcatacttcctcacatgtgctctggggccagcaaatcatctgtataccctgaccttggcccccgtgtacccccaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctgat

SEQ ID NO: 450068 - DNA, 3597 bp, Homo sapiens
tgctctgcccgttgctcagcaagttacttggggttccagtttgataagaaaagacttcctgtggaggaatctgaagggaaggaggaggagctggcccattcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgagtcccaggcaaggagagcaaggttggggtcagagggacgtggactgccgggcttcagcgccccaccccttcttgtgccttccaggtgatgagacccgaaatgtaggctcccaaactttacaaaccttcaaggcccgccaaggactgggggcgtcggtcgtcagctggagcgacgtcattgtggtgggccccgcggtacagggcacagggaacaatcgggggcagggacacctggggccaggaggagcccaagtctcgcgcccgtccccactcctgtggcctttctccaggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggcgagtagggagcaaaagcgcagtgggggcggctcccaaacagggccccctctcaccctcaggacttcccttccaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtgtggacacagctgctccgggccttggaggagagggccattccaatctggtgggtgctggtgggtgtgctgggtggcctgctgctgctcaccatcctggtcctggccatgtggaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctgat

SEQ ID NO: 450069 - DNA, 3511 bp, Homo sapiens
tgctctgcccgttgctcagcaagttacttggggttccagtttgataagaaaagacttcctgtggaggaatctgaagggaaggaggaggagctggcccattcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgagtcccaggcaaggagagcaaggttggggtcagagggacgtggactgccgggcttcagcgccccaccccttcttgtgccttccaggtgatgagacccgaaatgtaggctcccaaactttacaaaccttcaaggcccgccaaggactgggggcgtcggtcgtcagctggagcgacgtcattgtggtgggccccgcggtacagggcacagggaacaatcgggggcagggacacctggggccaggaggagcccaagtctcgcgcccgtccccactcctgtggcctttctccaggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcgcagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctgat

SEQ ID NO: 450070 - DNA, 313 bp, Homo sapiens
ctctaatgttttgtgttttttatttccaaaatgaaaatgcctaaaaagtagtagtgctacagcaatacacacactagcatgtgacagtcccttgagaccccaccccaagaaacccccccctccctaccttggcacacaaatctttccagaccttccaagggagcttaaatatatatatatgatgctctgtaatttctttcttggaactgccttcctgaagggctttgagagactcatctgtaatcagaagaaggagaatgagaccagggtggtgctgtgtgagctgggcaaccccatgaagaagaacgcccag

SEQ ID NO: 450071 - DNA, 3628 bp, Homo sapiens
tgctctgcccgttgctcagcaagttacttggggttccagtttgataagaaaagacttcctgtggaggaatctgaagggaaggaggaggagctggcccattcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgagtcccaggcaaggagagcaaggttggggtcagagggacgtggactgccgggcttcagcgccccaccccttcttgtgccttccaggtgatgagacccgaaatgtaggctcccaaactttacaaaccttcaaggcccgccaaggactgggggcgtcggtcgtcagctggagcgacgtcattgtggtgggccccgcggtacagggcacagggaacaatcgggggcagggacacctggggccaggaggagcccaagtctcgcgcccgtccccactcctgtggcctttctccaggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcgcagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtgtggacacagctgctccgggccttggaggagagggccattccaatctggtgggtgctggtgggtgtgctgggtggcctgctgctgctcaccatcctggtcctggccatgtggaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctgat

SEQ ID NO: 450072 - DNA, 3294 bp, Homo sapiens
tgctctgcccgttgctcagcaagttacttggggttccagtttgataagaaaagacttcctgtggaggaatctgaagggaaggaggaggagctggcccattcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgagtcccaggcaaggagagcaaggttggggtcagagggacgtggactgccgggcttcagcgccccaccccttcttgtgccttccaggtgatgagacccgaaatgtaggctcccaaactttacaaaccttcaaggcccgccaaggactgggggcgtcggtcgtcagctggagcgacgtcattgtggtgggccccgcggtacagggcacagggaacaatcgggggcagggacacctggggccaggaggagcccaagtctcgcgcccgtccccactcctgtggcctttctccaggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcgcagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtagtgagcaggctctctggtctctggcccggcctccccgggacccacggggcagaggggatgggaggagggagaggggtccgggtgtgctgtgggcctctgtgggccacgcttggtccctgggagcacttcaagtgaacatggaggagcatgctggcttgtgtctggggtgagctgaaagacacttgcactttttaaaagcttcccagtacgttaaggagcataaaacaatgccaaagcaaggtt

SEQ ID NO: 450073 - DNA, 514 bp, Homo sapiens
ggatacgctggaatctgcgcggcgctcacccagctttcctatgcagagtggccatcgtggtgggcgccccgcggaccctgggccccagccaggaggagacgggcggcgtgttcctgtgcccctggagggccgagggcggccagtgcccctcgctgctctttgacctccgtgagtcccaggcaaggagagcaaggttggggtcagagggacgtggactgccgggcttcagcgccccaccccttcttgtgccttccaggtgatgagacccgaaatgtaggctcccaaactttacaaaccttcaaggcccgccaaggactgggggcgtcggtcgtcagctggagcgacgtcattgtggtgggccccgcggtacagggcacagggaacaatcgggggcagggacacctggggccaggaggagcccaagtctcgcgcccgtccccactcctgtggcctttctccaggcctgcgccccctggcagcactggaacgtcctagaaaagactgaggaggctga

SEQ ID NO: 450074 - DNA, 1337 bp, Homo sapiens
ggaaaagaggtgggatcgtttgtcgcgatgtggagtggccgtaagctgggctcctccgggggttggtttttaagagtgctggggcctggaggctgtaatacaaaagctgcgcgtcccttaatttcctcggcggtttatgtgaagaaccagctcagtgggactctacagattaaaccaggggttttcaatgaatacagaaccatatggttcaaatcctacaggacgatcttttcctgtttgaacagaataaagagtttcaggtacccttgggcgagactgtacagtacttcccaaaccactgtcgacagcggtgaggtaaaaaccttcttggccctggctcacaaatggtgggatgaacaaggagtatatgcacctcttcattccatgaatgacctgagggtgccatttattagggacaatcttctgaaaacaattcctaatcaccagccaggaaaacctttgttggggatgaagattcttgacgttggctgtggtggtgggctgttaactgaacctctagggcggcttggggcttcagttattggaatcgaccctgtggatgagaacattaaaacagcacaatgccataaatcatttgatccagtcctggataagagaatagagtacagagtgtgttccctggaagagattgtggaagagactgcagaaacatttgatgctgttgtagcttctgaagttgtagaacatgtgattgatctagaaacatttttacagtgctgctgtcaagtgttaaaacccggtggttctttattcattactacaatcaacaaaacacaactttcctatgccttgggaattgttttttcagagcaaattgcaggtattgtaccaaaaggtactcatacatgggagaagtttgtttcacctgaaacactagagagcattctggaatcaaatggtctgtcagttcaaacagtggtaggaatgctctataaccccttctcaggttactggcattggagtgaaaataccagccttaactatgcagctcatgctgtgaaatccagggtccaggaacacccagcctctgctgagtttgttttaaagggagaaacagaagagctccaagctaatgcctgcaccaatccagctgtgcatgaaaagctgaagaaatgaattgtttctgagaactatagtaatatggcttggatatctgatgttttcaaatacaagaaatgtacaatttatcctttgagagagaatcatgaagaaaagaaggtcaataaaaagggctaaaaccttggacaaaagtttttgttatttcgtctaatagctactttcaagggattctgtgaataaaaagttttgtcaagata

SEQ ID NO: 450075 - DNA, 1460 bp, Homo sapiens
ggaaaagaggtgggatcgtttgtcgcgatgtggagtggccgtaagctgggctcctccgggggttggtttttaagagtgctggggcctggaggctgtaatacaaaagctgcgcgtcccttaatttcctcggcggtttatgtgaagaaccagctcagtgggactctacagattaaaccaggggttttcaatgaatacagaaccatatggttcaaatcctacaggacgatcttttcctgtttgaacagaataaagagtttcaggtggagtttcacttctgttgcccaggctggagtacaatggtgcgatcttggctcactgcaacctccacctcccgggttcaagcgattctcctgcctgagcctcctgagtcattgggattacaggtacccttgggcgagactgtacagtacttcccaaaccactgtcgacagcggtgaggtaaaaaccttcttggccctggctcacaaatggtgggatgaacaaggagtatatgcacctcttcattccatgaatgacctgagggtgccatttattagggacaatcttctgaaaacaattcctaatcaccagccaggaaaacctttgttggggatgaagattcttgacgttggctgtggtggtgggctgttaactgaacctctagggcggcttggggcttcagttattggaatcgaccctgtggatgagaacattaaaacagcacaatgccataaatcatttgatccagtcctggataagagaatagagtacagagtgtgttccctggaagagattgtggaagagactgcagaaacatttgatgctgttgtagcttctgaagttgtagaacatgtgattgatctagaaacatttttacagtgctgctgtcaagtgttaaaacccggtggttctttattcattactacaatcaacaaaacacaactttcctatgccttgggaattgttttttcagagcaaattgcaggtattgtaccaaaaggtactcatacatgggagaagtttgtttcacctgaaacactagagagcattctggaatcaaatggtctgtcagttcaaacagtggtaggaatgctctataaccccttctcaggttactggcattggagtgaaaataccagccttaactatgcagctcatgctgtgaaatccagggtccaggaacacccagcctctgctgagtttgttttaaagggagaaacagaagagctccaagctaatgcctgcaccaatccagctgtgcatgaaaagctgaagaaatgaattgtttctgagaactatagtaatatggcttggatatctgatgttttcaaatacaagaaatgtacaatttatcctttgagagagaatcatgaagaaaagaaggtcaataaaaagggctaaaaccttggacaaaagtttttgttatttcgtctaatagctactttcaagggattctgtgaataaaaagttttgtcaagata

SEQ ID NO: 450076 - DNA, 651 bp, Homo sapiens
  misc_feature (23)..(23): n is a, c, g, or t
tgttttatttgttttttaatttntttcccatctttggtcgtatatatcttttttattttattagtgatttcccggtggttctttattcattactacaatcaacaaaacacaactttcctatgccttgggaattgttttttcagagcaaattgcaggtattgtaccaaaaggtactcatacatgggagaagtttgtttcacctgaaacactagagagcattctggaatcaaatggtctgtcagttcaaacagtggtaggaatgctctataaccccttctcaggttactggcattggagtgaaaataccagccttaactatgcagctcatgctgtgaaatccagggtccaggaacacccagcctctgctgagtttgttttaaagggagaaacagaagagctccaagctaatgcctgcaccaatccagctgtgcatgaaaagctgaagaaatgaattgtttctgagaactatagtaatatggcttggatatctgatgttttcaaatacaagaaatgtacaatttatcctttgagagagaatcatgaagaaaagaaggtcaataaaaagggctaaaaccttggacaaaagtttttgttatttcgtctaatagctactttcaagggattctgtgaataaaaagttttgtcaagata

SEQ ID NO: 450077 - DNA, 657 bp, Homo sapiens
  misc_feature (10)..(10): n is a, c, g, or t
  misc_feature (21)..(21): n is a, c, g, or t
  misc_feature (27)..(27): n is a, c, g, or t
  misc_feature (63)..(63): n is a, c, g, or t
tttttatggnggcatttcccntttttnctggcccgtttttcccgatacccctccccacataanaattacccactttcccggtggttctttattcattactacaatcaacaaaacacaactttcctatgccttgggaattgttttttcagagcaaattgcaggtattgtaccaaaaggtactcatacatgggagaagtttgtttcacctgaaacactagagagcattctggaatcaaatggtctgtcagttcaaacagtggtaggaatgctctataaccccttctcaggttactggcattggagtgaaaataccagccttaactatgcagctcatgctgtgaaatccagggtccaggaacacccagcctctgctgagtttgttttaaagggagaaacagaagagctccaagctaatgcctgcaccaatccagctgtgcatgaaaagctgaagaaatgaattgtttctgagaactatagtaatatggcttggatatctgatgttttcaaatacaagaaatgtacaatttatcctttgagagagaatcatgaagaaaagaaggtcaataaaaagggctaaaaccttggacaaaagtttttgttatttcgtctaatagctactttcaagggattctgtgaataaaaagttttgtcaagata

SEQ ID NO: 450078 - DNA, 1334 bp, Homo sapiens
ggaaaagaggtgggatcgtttgtcgcgatgtggagtggccgtaagctgggctcctccgggggttggtttttaagagtgctggggcctggaggctgtaatacaaaagctgcgcgtcccttaatttcctcggcggtttatgtgaagaaccagctcagtgggactctacagattaaaccaggggttttcaatgaatacagaaccatatggttcaaatcctacaggacgatcttttcctgtttgaacagaataaagagtttcaggtacccttgggcgagactgtacagtacttcccaaaccactgtcgacagcggtgaggtaaaaaccttcttggccctggctcacaaatggtgggatgaacaaggagtatatgcacctcttcattccatgaatgacctgagggtgccatttattagggacaatcttctgaaaacaattcctaatcaccagccaggaaaacctttgttggggatgaagattcttgacgttggctgtggtggtgggctgttaactgaacctctagggcggcttggggcttcagttattggaatcgaccctgtggatgagaacattaaaacagcacaatgccataaatcatttgatccagtcctggataagagaatagagtacagagtgtgttccctggaagagattgtggaagagactgcagaaacatttgatgctgttgtagcttctgaagttgtagaacatgtgattgatctagaaacatttttacagtgctgctgtcaagtgttaaaacccggtggttctttattcattactacaatcaacaaaacacaactttcctatgccttgggaattgttttttcagagcaaattgcaggtattgtaccaaaaggtactcatacatgggagaagtttgtttcacctgaaacactagagagcattctggaatcaaatggtctgtcagttcaaacagtggtaggaatgctctataaccccttctcaggttactggcattggagtgaaaataccagccttaactatgcagctcatgctgtgaaatccagggtccaggaacacccagcctctgctgagtttgttttaaagggagaaacagaagagctccaagctaatgcctgcaccaatccagctgtgcatgaaaagctgaagaaatgaattgtttctgagaactatagtaatatggcttggatatctgatgttttcaaatacaagaaatgtacaatttatcctttgagagagaatcatgaagaaaagaaggggcccctcagaatgatatttggcctcacgggaggacatagcccctggaggtgctgttgctatagttgcaagcaggaggataatgccggaattcc

SEQ ID NO: 450079 - DNA, 1210 bp, Homo sapiens
ggaaaagaggtgggatcgtttgtcgcgatgtggagtggccgtaagctgggctcctccgggggttggtttttaagagtgctggggcctggaggctgtaatacaaaagctgcgcgtcccttaatttcctcggcgggtacccttgggcgagactgtacagtacttcccaaaccactgtcgacagcggtgaggtaaaaaccttcttggccctggctcacaaatggtgggatgaacaaggagtatatgcacctcttcattccatgaatgacctgagggtgccatttattagggacaatcttctgaaaacaattcctaatcaccagccaggaaaacctttgttggggatgaagattcttgacgttggctgtggtggtgggctgttaactgaacctctagggcggcttggggcttcagttattggaatcgaccctgtggatgagaacattaaaacagcacaatgccataaatcatttgatccagtcctggataagagaatagagtacagagtgtgttccctggaagagattgtggaagagactgcagaaacatttgatgctgttgtagcttctgaagttgtagaacatgtgattgatctagaaacatttttacagtgctgctgtcaagtgttaaaacccggtggttctttattcattactacaatcaacaaaacacaactttcctatgccttgggaattgttttttcagagcaaattgcaggtattgtaccaaaaggtactcatacatgggagaagtttgtttcacctgaaacactagagagcattctggaatcaaatggtctgtcagttcaaacagtggtaggaatgctctataaccccttctcaggttactggcattggagtgaaaataccagccttaactatgcagctcatgctgtgaaatccagggtccaggaacacccagcctctgctgagtttgttttaaagggagaaacagaagagctccaagctaatgcctgcaccaatccagctgtgcatgaaaagctgaagaaatgaattgtttctgagaactatagtaatatggcttggatatctgatgttttcaaatacaagaaatgtacaatttatcctttgagagagaatcatgaagaaaagaaggtcaataaaaagggctaaaaccttggacaaaagtttttgttatttcgtctaatagctactttcaagggattctgtgaataaaaagttttgtcaagata

SEQ ID NO: 450080 - DNA, 1324 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaa

SEQ ID NO: 450081 - DNA, 1502 bp, Homo sapiens
tacaatgatcaataatgctctcagtgtttatcagcacaaaatttacttgtgatagagataatgccagttccccttctagtggctcttaaaacctgaatttcttactcttatccacattcttttatatgaaactgcctttttatcatcttgctaccttgtgagctttctaacatggtgtctttggaccaaaggggagttcttttaaggtactagaagtgagttttcttagggtgggaaaaacatttctaggattgtgtgattgggatttcagtggaaagctttcaggtctctcatgaatgatgttgtcccagctatgttatattttagaccagacatgtactgatgacctttatgagttttgctggtatagatactgccatttagaatagaatcaatgtaaaatacgaaaattaaatatataaatgtacacagaaatctttctacacaaacatacattcagtattttgcaagtaggtttctttcaaggcatttttgccctaagaatacattatctaatgataaactgtaagttgtcagtacatttctcaattagaacatagttttcaaactctcctgcagagaatttgttttctagatttgttggtagagaacaaatttttattcttcacatttttatgctgccacatatatagcaaccagaatgttttttataatcctccagtagaggatttttctaatcattgacagaaacaaggtttattcatttcatttttaatagtactcttaaagtaaccaggatctttttcttaaaccagaaaaaattagtcacttttaatctgttttcattgcatgtcagtgtattgagggggaaagtctggaaatttgctatattgggcatgaaggacatgagtttaacatacgcttctaattccagattcttttgtgatcgacatttgatttctaactatctaaaaatagtatgtcaaatatgttttactcatatagcatcatttttttaaattaacttctctaaactttcaaccttgtttttaaaaattgctatttaaaaaaaaaaaaaaaactgtgtgaaaccaaaaatagcctgcatgtgttttatttttaattccttgtggctgggattggaggggaggtcacagtttgcttcaacagtgaaaatacattgcatgccagaaaagatccaaggataaaaattaataccaaggttttaaactgattattagtatttttaataactcatatttaaaatcaataggatgtacatataaacttatttttgtttttctaggtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaa

SEQ ID NO: 450082 - DNA, 1424 bp, Homo sapiens
tacaatgatcaataatgctctcagtgtttatcagcacaaaatttacttgtgatagagataatgccagttccccttctagtggctcttaaaacctgaatttcttactcttatccacattcttttatatgaaactgcctttttatcatcttgctaccttgtgagctttctaacatggtgtctttggaccaaaggggagttcttttaaggtactagaagtgagttttcttagggtgggaaaaacatttctaggattgtgtgattgggatttcagtggaaagctttcaggtctctcatgaatgatgttgtcccagctatgttatattttagaccagacatgtactgatgacctttatgagttttgctggtatagatactgccatttagaatagaatcaatgtaaaatacgaaaattaaatatataaatgtacacagaaatctttctacacaaacatacattcagtattttgcaagtaggtttctttcaaggcatttttgccctaagaatacattatctaatgataaactgtaagttgtcagtacatttctcaattagaacatagttttcaaactctcctgcagagaatttgttttctagatttgttggtagagaacaaatttttattcttcacatttttatgctgccacatatatagcaaccagaatgttttttataatcctccagtagaggatttttctaatcattgacagaaacaaggtttattcatttcatttttaatagtactcttaaagtaaccaggatctttttcttaaaccagaaaaaattagtcacttttaatctgttttcattgcatgtcagtgtattgagggggaaagtctggaaatttgctatattgggcatgaaggacatgagtttaacatacgcttctaattccagattcttttgtgatcgacatttgatttctaactatctaaaaatagtatgtcaaatatgttttactcatatagcatcatttttttaaattaacttctctaaactttcaaccttgtttttaaaaattgctatttaaaaaaaaaaaaaaaactgtgtgaaaccaaaaatagcctgcatgtgttttatttttaattccttgtggctgggattggaggggaggtcacagtttgcttcaacagtgaaaatacattgcatgccagaaaagatccaaggataaaaattaataccaaggttttaaactgattattagtatttttaataactcatatttaaaatcaataggatgtacatataaacttatttttgtttttctaggtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttca

SEQ ID NO: 450083 - DNA, 788 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgctgcttattactgtggcattcaatcaacctgttaagctttattccatgaaatttcaagggccagataatggtgagtaaaggatagct

SEQ ID NO: 450084 - DNA, 2129 bp, Homo sapiens
tacaatgatcaataatgctctcagtgtttatcagcacaaaatttacttgtgatagagataatgccagttccccttctagtggctcttaaaacctgaatttcttactcttatccacattcttttatatgaaactgcctttttatcatcttgctaccttgtgagctttctaacatggtgtctttggaccaaaggggagttcttttaaggtactagaagtgagttttcttagggtgggaaaaacatttctaggattgtgtgattgggatttcagtggaaagctttcaggtctctcatgaatgatgttgtcccagctatgttatattttagaccagacatgtactgatgacctttatgagttttgctggtatagatactgccatttagaatagaatcaatgtaaaatacgaaaattaaatatataaatgtacacagaaatctttctacacaaacatacattcagtattttgcaagtaggtttctttcaaggcatttttgccctaagaatacattatctaatgataaactgtaagttgtcagtacatttctcaattagaacatagttttcaaactctcctgcagagaatttgttttctagatttgttggtagagaacaaatttttattcttcacatttttatgctgccacatatatagcaaccagaatgttttttataatcctccagtagaggatttttctaatcattgacagaaacaaggtttattcatttcatttttaatagtactcttaaagtaaccaggatctttttcttaaaccagaaaaaattagtcacttttaatctgttttcattgcatgtcagtgtattgagggggaaagtctggaaatttgctatattgggcatgaaggacatgagtttaacatacgcttctaattccagattcttttgtgatcgacatttgatttctaactatctaaaaatagtatgtcaaatatgttttactcatatagcatcatttttttaaattaacttctctaaactttcaaccttgtttttaaaaattgctatttaaaaaaaaaaaaaaaactgtgtgaaaccaaaaatagcctgcatgtgttttatttttaattccttgtggctgggattggaggggaggtcacagtttgcttcaacagtgaaaatacattgcatgccagaaaagatccaaggataaaaattaataccaaggttttaaactgattattagtatttttaataactcatatttaaaatcaataggatgtacatataaacttatttttgtttttctaggtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaaaaaacacacagaaaaacaccttacactcacacacatacaccttcatacacacactttttacccccgcccctcctcccccctactaccaaagactattacataaaccacatatctctataataaaaacaactagatcaccacaaaacagtgtataacagagtaccaacagagagagcagtatacacgaggacatcacacggagagacaacactaacggagataatcgcgtacaaagcgaatatgcacatttctacacgacaaaaaaaaacaaagccccgggcgagaaaaaaacaaaaaagagagctctatcctgaaaaaaacacactctcgcaagcttgggcaggcatatctcggggcccacatcacgaagtggaacacatcaataccgaacaccgggaggctaccccaagaggagaaagcatccacgcaaaataatcatagagaataaaaagaagccccacgagagcagacaagtgtgaagcaaacaatcagaagcacaaggatcaacgcaggcgacaggcgacgcacgcatcagagcgagcagggagcaacgaaaggcgcagcaaccagaacgagagaaaaggcgcaggagtgaagagcaacaagggcggagaagcgcaggggagc

SEQ ID NO: 450085 - DNA, 1145 bp, Homo sapiens
ggattttttgtgttgcagcatgaaaagcttgccattgccatcttaattggaagtagatgtttttgctaaaatatgctctttatatggattgctttattttaatacagaatttttaattacaattttataaaaatacaaaaatgagaaaattataggggcttctgcttcttaggaaatgaggtgcatgtgaaaagatttttatcactataataaaaatagacttttctaaactggccattcaccgtatcagctatttttgtaacatttctgtctgtttatttttcagcttttttaatccaactcaaatgaactaaaaacagaagatattttaaaatgaagtaatataaagattgaccttgtctcactctactcccctccttgcttctctgctcatctagcacctgtctgctctcacccttcccatgttctcgccattgttggtgcaagatttctacagcttctatcatctggatcagccttgttacctaggtttcctcaatcatctctttcttcagatctcatcctagttgtgtttcttaattggccttttattttgttttggcttttgttttgggcttgcaactaggtgctttaattttttaccataccgtgttgctcactagcctttttttttttttactttctactgtttcatatttaattttgtattacattttgaggcataacatcacaataaaattaaattgttataaaatgttttagatttaactagttgaatagttttaatccattctaaactttaaattttatttcctaggaactatagaattcttttggaaaacaaatatagcagttgcatcaagttcttttatgtttgtgctagtttaatatattgattacatttcagttgaggggtgttggttttcttttcctcgttggaatgttagccccaaagtccttttgatgattgattggggcatgtcctctgcttttgcccaagtgagctcaaaaccagttgaaggacttatggactgaatattaggttgggttaacatattaatatagaagatcaatggactctttactgaataaatattttttacacctaatttttatgtacctaaattttggtttgtctgaggtgtaatataaagacttaagaatgaataaaagagctttacgtt

SEQ ID NO: 450086 - DNA, 1246 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttca

SEQ ID NO: 450087 - DNA, 1633 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaatttttgtctttctaaatcagtattttctctttccatgtatttgaaaactggttaacttctgattttagtagagacttaagtgtctggtagtatattgattgaaagccagtttctttagaaaaggagaaactgttctagggaattaagaagtacatgtgtacacattcatggcaagttattttgataagtgaacctggaacagctaaccatgttaaattattactgcatttttattaaaggacatttgtatatctgagctatggaaattactcaaattataaattagaagaaataaacaggtttaatgag

SEQ ID NO: 450088 - DNA, 1238 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgaatgaaacattgacaggtcgacgcggccgcgaat

SEQ ID NO: 450089 - DNA, 1836 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgacacctgtctgctctcacccttcccatgttctcgccattgttggtgcaagatttctacagcttctatcatctggatcagccttgttacctaggtttcctcaatcatctctttcttcagatctcatcctagttgtgtttcttaattggccttttattttgttttggcttttgttttgggcttgcaactaggtgctttaattttttaccataccgtgttgctcactagcctttttttttttttactttctactgtttcatatttaattttgtattacattttgaggcataacatcacaataaaattaaattgttataaaatgttttagatttaactagttgaatagttttaatccattctaaactttaaattttatttcctaggaactatagaattcttttggaaaacaaatatagcagttgcatcaagttcttttatgtttgtgctagtttaatatattgattacatttcagttgaggggtgttggttttcttttcctcgttggaatgttagccccaaagtccttttgatgattgattggggcatgtcctctgcttttgcccaagtgagctcaaaaccagttgaaggacttatggactgaatattaggttgggttaacatattaatatagaagatcaatggactctttactgaataaatattttttacacctaatttttatgtacctaaattttggtttgtctgaggtgtaatataaagacttaagaatgaataaaagagctttacgtt

SEQ ID NO: 450090 - DNA, 1128 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttactcagcaatccctttactgggtgtatattataaatcattctactataaagacacatgcacacatatattcattgcaacacggtctctca

SEQ ID NO: 450091 - DNA, 941 bp, Homo sapiens
cctttactcatttttgggccatcacaggctgtttcttggagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaa

SEQ ID NO: 450092 - DNA, 1264 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatgaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaa

SEQ ID NO: 450093 - DNA, 283 bp, Homo sapiens
ctgcacccagcctagattaatttttacaaagaatggagaatatttatgttattaatttaaggaaattgattaaacttaaagcatgtttgtgaagaaggattgtaattataaatgcaaacttttttttggtagatatttgttcagtcgaatcaaggtgaagaggaaacaacaagaatttcatattttacttttattggtactccagtccaggcaacaaatatgaatgacttcaaacgagtaagtttgcttaaatgatacttcgggatagtaaaaatataatttt

SEQ ID NO: 450094 - DNA, 829 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagacttgctattactattacattcaatcaaacctctaacttgtatcccataaatttcaaggccacataattttcaataccctaaattata

SEQ ID NO: 450095 - DNA, 1951 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaaaaaacacacagaaaaacaccttacactcacacacatacaccttcatacacacactttttacccccgcccctcctcccccctactaccaaagactattacataaaccacatatctctataataaaaacaactagatcaccacaaaacagtgtataacagagtaccaacagagagagcagtatacacgaggacatcacacggagagacaacactaacggagataatcgcgtacaaagcgaatatgcacatttctacacgacaaaaaaaaacaaagccccgggcgagaaaaaaacaaaaaagagagctctatcctgaaaaaaacacactctcgcaagcttgggcaggcatatctcggggcccacatcacgaagtggaacacatcaataccgaacaccgggaggctaccccaagaggagaaagcatccacgcaaaataatcatagagaataaaaagaagccccacgagagcagacaagtgtgaagcaaacaatcagaagcacaaggatcaacgcaggcgacaggcgacgcacgcatcagagcgagcagggagcaacgaaaggcgcagcaaccagaacgagagaaaaggcgcaggagtgaagagcaacaagggcggagaagcgcaggggagc

SEQ ID NO: 450096 - DNA, 1709 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcaaaaaaaaaaaaaaaaaaaaaaaaaaaaaaaaaaaaaaaaaaaaaaaaaagggggggggggcaaaaaaaacccccggggggggccaaatgggccaccattttttggaaagagggggcgaccccaaaaaaggaagcgcgtggaattaaaataagaaaagcacggacggccgccggcgatataaacaacacagcgatcgcgagcgtgggagaaaaaaagcgataaaagcgggacacattgcgggaaagacaaccaccacaacatcggcggggggcgcgacaactaatggggggaaaccacccacccagagaaaagattaaaccgcccacggagagcgaaaaactcaaaccagtcagggaggtcatacgggggtgcacacgaagagtaataatcgtggaccggaaagaagattagcgcacaggacgacaaattatcagagaacatctatacccggggccagatgtag

SEQ ID NO: 450097 - DNA, 1380 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgacacctgtctgctctcacccttcccatgttctcgccattgttggtgcaagatttctacagcttctatcatctggatcagccttgttacctagaaaatacacattggcaagttgagagttatcaacctgtgaaacagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttca

SEQ ID NO: 450098 - DNA, 1429 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagtacttattcctttgaagataggaagatgttatgttgatgtcattattacagatgtcattatggctgcattagttaagaagagtagcacattattaattgcttcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaa

SEQ ID NO: 450099 - DNA, 1284 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaa

SEQ ID NO: 450100 - DNA, 612 bp, Homo sapiens
aaaatgaaactcttatcttcacagctgctctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaa

SEQ ID NO: 450101 - DNA, 372 bp, Homo sapiens
tcgaacgaacgtggagctcagcatcccccccacaccacgacccgccgtcacaggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcaaaaaaatgt

SEQ ID NO: 450102 - DNA, 514 bp, Homo sapiens
cctagttttagaagtttcaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatgtgctattaaacttctagaactagggggatcctctatgat

SEQ ID NO: 450103 - DNA, 3451 bp, Homo sapiens
agggcgaggaggagaaggaggggcaggagggtttggttgagctgcagctgtttgtctgttcgacacaggcttggggccgacgggggagacggagccccaggtaacactggatcaacaaaatgaagagctgagccaagtggtagaactctcatttcaagattttggtgacttgggtttaaacagagttggagagggagatgaaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcaaaaaaatgt

SEQ ID NO: 450104 - DNA, 2945 bp, Homo sapiens
gggaagaccacctagaagaggtgaattttgagactcattttaaaaggtgatggatatggattggcagtcattccagcctactcattctcttcatgttttcctaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcaaaaaaatgt

SEQ ID NO: 450105 - DNA, 2642 bp, Homo sapiens
agcgggttcgacacaggcttgcgggccgacgggggagacggagccccaggagtgttgaagcctggaaatcccctccgcttccgccaaccggtgtgatctccatgacagcccacggccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcaaaaaaatgt

SEQ ID NO: 450106 - DNA, 2597 bp, Homo sapiens
ctcttctctttttatctctagctaagaagttgccaaagagtgaaccccagaatctgggaggtgcagcaggccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcaaaaaaatgt

SEQ ID NO: 450107 - DNA, 3293 bp, Homo sapiens
agggcgaggaggagaaggaggggcaggagggtttggttgagctgcagctgtttgtctgttcgacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcgaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcaaaaaaatgt

SEQ ID NO: 450108 - DNA, 1962 bp, Homo sapiens
gccgcctcccaaatcgcatccttcaccgtccccccgttggaagaaagctacggtacgaggctgggatatgaattggcagagggaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcaaaaaaatgt

SEQ ID NO: 450109 - DNA, 1072 bp, Homo sapiens
tactctgatcaagttaaggtaccttcagtgccggtcattccctctccacaggaacaggtggtatgatacgagggcaccacaggaggcctctgtggtactagcccctattggtacatggattaaaccactggttgcatgatggggagggatggggggattaaggatggagggactaaattcaagatattaacaaaggaacaaagaaacaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcaaaaaaatgt

SEQ ID NO: 450110 - DNA, 2139 bp, Homo sapiens
  misc_feature (2123)..(2123): n is a, c, g, or t
agggcgaggaggagaaggaggggcaggagggtttggttgagctgcagctgtttgtctgttcgacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggatcctctagagcgacngcaggcagggagacaa

SEQ ID NO: 450111 - DNA, 726 bp, Homo sapiens
agggcgaggaggagaaggaggggcaggagggtttggttgagctgcagctgtttgtctgttcgacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagtaaggtggcccgtggagttcctctctaacacttcctctgttcctgggacctctttttttccaaaccagcccggcccggcccccagcccggcccgg

SEQ ID NO: 450112 - DNA, 3348 bp, Homo sapiens
agggcgaggaggagaaggaggggcaggagggtttggttgagctgcagctgtttgtctgttcgacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcaaaaaaatgt

SEQ ID NO: 450113 - DNA, 3394 bp, Homo sapiens
agggcgaggaggagaaggaggggcaggagggtttggttgagctgcagctgtttgtctgttcgacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagaacgggtaaaaaccaaaaagaatgcccaccaagggctttgggcttttgccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcaaaaaaatgt

SEQ ID NO: 450114 - DNA, 3302 bp, Homo sapiens
agggcgaggaggagaaggaggggcaggagggtttggttgagctgcagctgtttgtctgttcgacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcaaaaaaatgt

SEQ ID NO: 450115 - DNA, 1366 bp, Homo sapiens
agggcgaggaggagaaggaggggcaggagggtttggttgagctgcagctgtttgtctgttcgacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaagga

SEQ ID NO: 450116 - DNA, 577 bp, Homo sapiens
agggcgaggaggagaaggaggggcaggagggtttggttgagctgcagctgtttgtctgttcgacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcacacaatgataactacatggggctacaccacaagcattttccaattacgacattttgtaatccgacacactgtgcacgacctgacaaaacaggatcgaacgaacaccagagacacacctgtcgataca

SEQ ID NO: 450117 - DNA, 2988 bp, Homo sapiens
tgctgcttggtttctcacacaaaccctgctgtggctgcttaccatcctcagcaagggtgcggaggaatggaaacttttgccaccaacagcatttgctagcaacttccctctctgtggtttttctgtcattcccttgataaaagaacttgagctgcgcaaaagtaaccaatcttcaccaatctcatcttcacatataaacagccgcctttcaagaagcaagctgccagaaaaatgatgcacgatgctctctaaactgggtcattctccacttggagggctcagggcacggttgactttccccgtctgtctcctataccacaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacgaaacattggatcatgacatgtcgggcgatgcttggaagagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtcctctgtaaggtgtcaggcaagccaaaaaaaaaaaaaagatgcgtaagtcctaacccccaacagaggtgttcacagtgtagacagggaaaaaatgtataaacaaatgtgtaaaaagagaaatcagctcatggcttaggatggaattagagacaggtgagggacactcaggagctcattttccagctgctcttcagagtggaagggctggctggatcgggtaggtaagaatagctggattttttagaaaagaaatggatacagtctaaagaattaactcacccggtactttattctaagaagggtctggcatccatatgaggaaaaatgctcagctccaggaaagatggggagtccaagtggattaatgatgtcatgcataattttaagagacaagggagaaaacacaatgtatagccagagaaggagaagctcccatccaaatcctactaggaagagagtgggctgcagatgaatctgtgactcatgtttccctgtttcaaagggatcctggggaaggaggggaacatgcttgcagtatctctccctgtctgtctgctcacataagcattccgtccatctgagctcatcgtgctactggtatgtgtatgtgcagttacacagttttctgtatcatagattctagtgtgtttatacaaggagacatctgtggtttccccaaccgttccaaaaggctatttcaaaggaaccagccaacgtatgagaaatgaatgtaacactgtggacattgacttcccgcataaggcagggtgaccccctgaactccagatgtctgcacagtatcttatgtgttgttttccgttgtgacgaatgtgattggaacatttggggagcacccagagggatttctcagtgggaagcattacactttgctaaatcatgtatttattcctgattaaaacaaacctaataaatatttaacccttggca

SEQ ID NO: 450118 - DNA, 1136 bp, Homo sapiens
tgctgcttggtttctcacacaaaccctgctgtggctgcttaccatcctcagcaagggtgcggaggaatggaaacttttgccaccaacagcatttgctagcaacttccctctctgtggtttttctgtcattcccttgataaaagaacttgagctgcgcaaaagtaaccaatcttcaccaatctcatcttcacatataaacagccgcctttcaagaagcaagctgccagaaaaatgatgcacgatgctctctaaactgggtcattctccacttggagggctcagggcacggttgactttccccgtctgtctcctataccacaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgagtgagtcagctctccaaaacttgtgcaatcttcaaagcaggataaacttggtttgggagaaaagtatttgattgttagctagagtggtctagttccacatgagtcctggtcctattatgaggtgagaaatttgacccatactgcaaccttcctctttaatgtggccagtgctctagaaccttccatagctccccactgcctggtagatcaaatttaaattccttaacttggcttttgagatcctttatgatccagcctcttctcatattcttcttatctcccaccacatgtgcagtgttgatgctatgtaggaatgaagaccgggaaggcagcccccagggtctggaaatccttcggatgagaaaaaacaaaaatttgccttctctcctcttacctctgcagtctgattcaatatgggctatagaacatgacagaagttctaagccccttttatttagatcttcactgattcagatatatgaaactatctttggctatactgcagagcataaatcaacatagtaaacatttatttttaaaaagcctccaacagttgggaacattagctgctaatccctgaaaagcagctatttctagcacatgggagggtttac

SEQ ID NO: 450119 - DNA, 4626 bp, Homo sapiens
tcatgaaatacaatattttaatattttgggggggacaagtcagtccttctgatcctcagctttctctgaaccataatcccagctcacagggcccctggggagaattagacaacgtgacgtgtaagcgtcagctgtgaggggtaatgtggggctatagctccagggtggagggtttacagtgtgcaagggcatcctagagccatgagacctacagggctctctgggtgttgggagatacctctttcgcttcttataacactgcaagagacagacagggtggctctcactgtgtccatttgaaggctaaagaaactgcagctcagaccagttcagcaactctcctacatcgtgtggctaaagctaagaattgtgacccatttttctgaatccaggtccccgcgatgccctgggttcagaccctaacaccctcccgtccctgagtgctggggatttaaggcagcagtgcctcctttcaggaaatcacacacacactggaaactcctgcatactcctcttactataatctgtcaccaaagactggatattcctgtgctggggctcgtgccagcgcctcgggctgccaggtgctgctttccaactcccacatgggctgccctccccctactgctacccacagggcccccactccacctgctcccagacgaggccaactcctggccaagcttaggggcacagcggaggcgctctgtttctgatttttctcgccttccttggagatgcctgtgcttggaagggaaggcagaacattgcatcttggaacaaatctgcttttgatcatgcaaatgaatgcctggataatgtaggcagactgtcaatttcaccagttagaaagaaagagaaaagggggagaaattccccatgacagcgactgatgaagaatttcaatagaaagctgctacttcagaaaataagatcatttgctgcgaatggagaacatctcaggcagccctgatgctccaccggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacgaaacattggatcatgacatgtcgggcgatgcttggaagagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtcctctgtaaggtgtcaggcaagccaaaaaaaaaaaaaagatgcgtaagtcctaacccccaacagaggtgttcacagtgtagacagggaaaaaatgtataaacaaatgtgtaaaaagagaaatcagctcatggcttaggatggaattagagacaggtgagggacactcaggagctcattttccagctgctcttcagagtggaagggctggctggatcgggtaggtaagaatagctggattttttagaaaagaaatggatacagtctaaagaattaactcacccggtactttattctaagaagggtctggcatccatatgaggaaaaatgctcagctccaggaaagatggggagtccaagtggattaatgatgtcatgcataattttaagagacaagggagaaaacacaatgtatagccagagaaggagaagctcccatccaaatcctactaggaagagagtgggctgcagatgaatctgtgactcatgtttccctgtttcaaagggatcctggggaaggaggggaacatgcttgcagtatctctccctgtctgtctgctcacataagcattccgtccatctgagctcatcgtgctactggtatgtgtatgtgcagttacacagttttctgtatcatagattctagtgtgtttatacaaggagacatctgtggtttccccaaccgttccaaaaggctatttcaaaggaaccagccaacgtatgagaaatgaatgtaacactgtggacattgacttcccgcataaggcagggtgaccccctgaactccagatgtctgcacagtatcttatgtgttgttttccgttgtgacgaatgtgattggaacatttggggagcacccagagggatttctcagtgggaagcattacactttgctaaatcatgtatttattcctgattaaaacaaacctaataaatatttaacccttggcaaaaagggagagtttctgggttgaggaggatgggtggttcattcagaagctcagtgggtttcaaattttcaaataaacgtgcaactagagagagaggagtaaagatcacccagagaaacctggtgccagttagcagctcagcatcttctttaggtgtgaccttaagaaaaagcagattgtatgactctggggggtgtcttacgaaacttgaagatgggcctaagggattgaaggaaacaccaaattctgaacgattgttataaaaacgtcctgcctagattttctgcacgttacttgtgatagctgcgctatttgttcttccaagaatttctttctgcagatatttctggacacctactaaatagacactgctcaggtactggggctatagcaatgaaaaccagatgaggtctctgatatcatggagcttgacatcataaataaacaagatgcttggtaatgatggtgatgaggatgagggcaggctccaagcagtcacctggcaggcaggacatccttcaggtccaggcttaggaaaggcctccaagcagaggcaatgtttgggctgaggcctgaaagatgagcagcaaacagccttgtaaagatctaggaagtgtatggagtcagcaggaataatggggcaattcctgcaggcaggaagagcaagactgcatgctgaaggagctaaaaggaggcagggtggccagactgagggagctagggaaggagggagtgtgcttaggaggtatcaggaaggtcctgcagggccctagagggtaggggatggcatagggtccattccaggagacatgaggagccattgaaaggatccaagtagggggtaagaccatttcactgatatgtttaaaagatcatgctgtgtggaggacaaatctttaaaattccagcattgtattgtctattgacacacaaagtttgaaaataaaggggcaaaaaattttaatgcaaaaatgaac

SEQ ID NO: 450120 - DNA, 3319 bp, Homo sapiens
tcatgaaatacaatattttaatattttgggggggacaagtcagtccttctgatcctcagctttctctgaaccataatcccagctcacagggcccctggggagaattagacaacgtgacgtgtaagcgtcagctgtgaggggtaatgtggggctatagctccagggtggagggtttacagtgtgcaagggcatcctagagccatgagacctacagggctctctgggtgttgggagatacctctttcgcttcttataacactgcaagagacagacagggtggctctcactgtgtccatttgaaggctaaagaaactgcagctcagaccagttcagcaactctcctacatcgtgtggctaaagctaagaattgtgacccatttttctgaatccaggtccccgcgatgccctgggttcagaccctaacaccctcccgtccctgagtgctggggatttaaggcagcagtgcctcctttcaggaaatcacacacacactggaaactcctgcatactcctcttactataatctgtcaccaaagactggatattcctgtgctggggctcgtgccagcgcctcgggctgccaggtgctgctttccaactcccacatgggctgccctccccctactgctacccacagggcccccactccacctgctcccagacgaggccaactcctggccaagcttaggggcacagcggaggcgctctgtttctgatttttctcgccttccttggagatgcctgtgcttggaagggaaggcagaacattgcatcttggaacaaatctgcttttgatcatgcaaatgaatgcctggataatgtaggcagactgtcaatttcaccagttagaaagaaagagaaaagggggagaaattccccatgacagcgactgatgaagaatttcaatagaaagctgctacttcagaaaataagatcatttgctgcgaatggagaacatctcaggcagccctgatgctccaccggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacgaaacattggatcatgacatgtcgggcgatgcttggaagagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtcctctgtaaggtgtcaggcaagccaaaaaaaaaaaaaagatgcgtaagtcctaacccccaacagaggtgttcacagtgtagacagggaaaaaatgtataaacaaatgtgtaaaaagagaaatcagctcatggcttaggatggaattagagacaggtgagggacactcaggagctcattttccagctgctcttcagagtggaagggctggctggatcgggtaggtaagaatagctggattttttagaaaagaaatggatacagtctaaagaattaactcacccggtactttattctaagaagggtctggcatccatatgaggaaaaatgctcagctccaggaaagatggggagtccaagtggattaatgatgtcatgcataattttaagagacaagggagaaaacacaatgtatagccagagaaggagaagctcccatccaaatcctactaggaagagagtgggctgcagatgaatctgtgactcatgtttccctgtttcaaagggatcctggggaaggaggggaacattgcctggaggtttttttttcttgtttggcctgttcacttaaatcattccgttcatattgaatccaatctgtctactagatttgggtttgg

SEQ ID NO: 450121 - DNA, 515 bp, Homo sapiens
gtaatcccagctacttgggaggctgaggcaggagaatcacttgaacctggaaggtggaggatgcagtgaaccaaggtcgcgccactgttctctagtctgggtgatagagcagggatccatttccaaaaaaaaaattacataaataaaaggaagagcagcagtgaagtgaggtggttatggaattggatgtcccagaaaaatgcattctaattttaactctatcaactgctgacatggtttcctgagcaaactacttaatcactggaaccctcagtattctcatctgtggaagagagatgatgcttcctgtctcagtgggttgaggtgaggattaggtttcaggtgcttagtacggtgggtggcgcattcctgcctttcctgggggagggcttgttccggatcctaatggctgtcttcctccttcccagctggctgtttgagggcctgggcagagacaaggccgaggagctgctgcagctgccagacacaaaggtcggctccttcatgatcagaga

SEQ ID NO: 450122 - DNA, 359 bp, Homo sapiens
aagtcattgtgtctctttagtctcctttaatctcaaagcattgctctggggtccattcggcagtaacagaaggaagctgcaaaaattgggaaaccgaaatcagagaagctgcagctcttagccacagccttcgtgggcccagagagttctggggatgtacaagagcaaattcacagccccattgatttgccttttaattagagaaagaagaccaagcttctgaaattccagaatccagagttaagctggccatattctcaaatgctttgtaaaaaaattaataacccatctatcttcccagtccttgcagagagaagcttgctcagagtggttactgaaaacaggaacctgcccttctg

SEQ ID NO: 450123 - DNA, 489 bp, Homo sapiens
gcatttgctagcaacttccctctctgtggtttttctgtcattcccttgataaaagaacttgagctgcgcaaaagtaaccaatcttcaccaatctcatcttcacatataaacagccgcctttcaagaagcaagctgccagaaaaatgatgcacgatgctctctaaactgggtcattctccacttggagggctcagggcacggttgactttccccgtctgtctcctataccacaggctctgggcatcaccagcggccccagggaaaaagaaagaaatgggaaacagcatgaaatccacccctgcgcctgccgagaggcccctgcccaacccggagggtaagtctggcttctctggtgagatgcttgagtctgtgctacaagagcctgtggtaaagactgggcggtggtggatgccggtaactacttaaatggggcaatgggtaccgaagggctcattatatctgtctctctagttttgtttgtggttcaaa

SEQ ID NO: 450124 - DNA, 3650 bp, Homo sapiens
tcatgaaatacaatattttaatattttgggggggacaagtcagtccttctgatcctcagctttctctgaaccataatcccagctcacagggcccctggggagaattagacaacgtgacgtgtaagcgtcagctgtgaggggtaatgtggggctatagctccagggtggagggtttacagtgtgcaagggcatcctagagccatgagacctacagggctctctgggtgttgggagatacctctttcgcttcttataacactgcaagagacagacagggtggctctcactgtgtccatttgaaggctaaagaaactgcagctcagaccagttcagcaactctcctacatcgtgtggctaaagctaagaattgtgacccatttttctgaatccaggtccccgcgatgccctgggttcagaccctaacaccctcccgtccctgagtgctggggatttaaggcagcagtgcctcctttcaggaaatcacacacacactggaaactcctgcatactcctcttactataatctgtcaccaaagactggatattcctgtgctggggctcgtgccagcgcctcgggctgccaggtgctgctttccaactcccacatgggctgccctccccctactgctacccacagggcccccactccacctgctcccagacgaggccaactcctggccaagcttaggggcacagcggaggcgctctgtttctgatttttctcgccttccttggagatgcctgtgcttggaagggaaggcagaacattgcatcttggaacaaatctgcttttgatcatgcaaatgaatgcctggataatgtaggcagactgtcaatttcaccagttagaaagaaagagaaaagggggagaaattccccatgacagcgactgatgaagaatttcaatagaaagctgctacttcagaaaataagatcatttgctgcgaatggagaacatctcaggcagccctgatgctccaccggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacgaaacattggatcatgacatgtcgggcgatgcttggaagagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtcctctgtaaggtgtcaggcaagccaaaaaaaaaaaaaagatgcgtaagtcctaacccccaacagaggtgttcacagtgtagacagggaaaaaatgtataaacaaatgtgtaaaaagagaaatcagctcatggcttaggatggaattagagacaggtgagggacactcaggagctcattttccagctgctcttcagagtggaagggctggctggatcgggtaggtaagaatagctggattttttagaaaagaaatggatacagtctaaagaattaactcacccggtactttattctaagaagggtctggcatccatatgaggaaaaatgctcagctccaggaaagatggggagtccaagtggattaatgatgtcatgcataattttaagagacaagggagaaaacacaatgtatagccagagaaggagaagctcccatccaaatcctactaggaagagagtgggctgcagatgaatctgtgactcatgtttccctgtttcaaagggatcctggggaaggaggggaacatgcttgcagtatctctccctgtctgtctgctcacataagcattccgtccatctgagctcatcgtgctactggtatgtgtatgtgcagttacacagttttctgtatcatagattctagtgtgtttatacaaggagacatctgtggtttccccaaccgttccaaaaggctatttcaaaggaaccagccaacgtatgagaaatgaatgtaacactgtggacattgacttcccgcataaggcagggtgaccccctgaactccagatgtctgcacagtatcttatgtgttgttttccgttgtgacgaatgtgattggaacatttggggagcacccagagggatttctcagtgggaagcattacactttgctaaatcatgtatttattcctgattaaaacaaacctaataaatatttaacccttggca

SEQ ID NO: 450125 - DNA, 3928 bp, Homo sapiens
tcatgaaatacaatattttaatattttgggggggacaagtcagtccttctgatcctcagctttctctgaaccataatcccagctcacagggcccctggggagaattagacaacgtgacgtgtaagcgtcagctgtgaggggtaatgtggggctatagctccagggtggagggtttacagtgtgcaagggcatcctagagccatgagacctacagggctctctgggtgttgggagatacctctttcgcttcttataacactgcaagagacagacagggtggctctcactgtgtccatttgaaggctaaagaaactgcagctcagaccagttcagcaactctcctacatcgtgtggctaaagctaagaattgtgacccatttttctgaatccaggtccccgcgatgccctgggttcagaccctaacaccctcccgtccctgagtgctggggatttaaggcagcagtgcctcctttcaggaaatcacacacacactggaaactcctgcatactcctcttactataatctgtcaccaaagactggatattcctgtgctggggctcgtgccagcgcctcgggctgccaggtgctgctttccaactcccacatgggctgccctccccctactgctacccacagggcccccactccacctgctcccagacgaggccaactcctggccaagcttaggggcacagcggaggcgctctgtttctgatttttctcgccttccttggagatgcctgtgcttggaagggaaggcagaacattgcatcttggaacaaatctgcttttgatcatgcaaatgaatgcctggataatgtaggcagactgtcaatttcaccagttagaaagaaagagaaaagggggagaaattccccatgacagcgactgatgaagaatttcaatagaaagctgctacttcagaaaataagatcatttgctgcgaatggagaacatctcaggcagccctgatgctccaccgtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaggcccggctgcctgtttattctggagcagcagcagttgacagacggagaggcagtgactctgcacccagcaatccctctgcagacagctcccacaggagtcatgcccagtgtgtgaaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacgaaacattggatcatgacatgtcgggcgatgcttggaagagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtcctctgtaaggtgtcaggcaagccaaaaaaaaaaaaaagatgcgtaagtcctaacccccaacagaggtgttcacagtgtagacagggaaaaaatgtataaacaaatgtgtaaaaagagaaatcagctcatggcttaggatggaattagagacaggtgagggacactcaggagctcattttccagctgctcttcagagtggaagggctggctggatcgggtaggtaagaatagctggattttttagaaaagaaatggatacagtctaaagaattaactcacccggtactttattctaagaagggtctggcatccatatgaggaaaaatgctcagctccaggaaagatggggagtccaagtggattaatgatgtcatgcataattttaagagacaagggagaaaacacaatgtatagccagagaaggagaagctcccatccaaatcctactaggaagagagtgggctgcagatgaatctgtgactcatgtttccctgtttcaaagggatcctggggaaggaggggaacatgcttgcagtatctctccctgtctgtctgctcacataagcattccgtccatctgagctcatcgtgctactggtatgtgtatgtgcagttacacagttttctgtatcatagattctagtgtgtttatacaaggagacatctgtggtttccccaaccgttccaaaaggctatttcaaaggaaccagccaacgtatgagaaatgaatgtaacactgtggacattgacttcccgcataaggcagggtgaccccctgaactccagatgtctgcacagtatcttatgtgttgttttccgttgtgacgaatgtgattggaacatttggggagcacccagagggatttctcagtgggaagcattacactttgctaaatcatgtatttattcctgattaaaacaaacctaataaatatttaacccttggca

SEQ ID NO: 450126 - DNA, 1529 bp, Homo sapiens
cgctggagtcccgccccgccaggatcccgggagctgtccggccgcctcggtgctgatcccgccaccgcccacgggccgctagcagcgcagcgggcactatgagcgggggcgtctacggcggagatgaggtgggggcgctggtctttgacattggctccttctcagtccgcgctgggtacgctggggaggactgtcccaaggctgacttccccaccacagtggggctgctggccgcggaggaggggggcgggctggagctggagggggacaaagagaagaaagggaagatcttccacatcgacaccaatgccctgcacgtgcctcgggatggagcggaggtcatgtcgcccctcaagaatggcatgatcgaggactgggagtgcttccgagccatcctggatcacacctacagcaaacacgtcaagtctgagccaaacctgcacccagtgctcatgtccgaggctccgtggaacacacgggccaagcgggagaagctgacagagctgatgttcgagcagtacaacattcctgccttcttcttatgcaagacggctgtgctcaccgcctttgcaaacgggcggtccactggcctcgtgctggacagtggagccacccacaccacggccattccagtacatgacggctacgttctgcagcaaggcatcgtcaagtcccctctggcaggggacttcatctccatgcagtgccgggagctgttccaggagatggccattgacatcatcccaccttacatgatcgcagccaaggagcctgtccgggagggtgcccccccaaactggaagaagaaggagaagctaccccaggtctccaagtcctggcataactacatgtgtaatgaggtgatccaggacttccaggcctccgtgctgcaggtctcagactccccctacgatgaacaggtggctgcacaaatgcccacagtgcactacgagatgcccaatggctacaatacagactacggcgccgagcgactccgcatccctgagggcctgtttgatccctcgaacgtcaagggcctgtcggggaacaccatgttgggtgtgggccacgtggtgaccaccagcatcggcatgtgtgacattgatattcgcccgggcctgtacgggagtgtcattgtcaccggcgggaacacactgctgcagggcttcactgacaggctcaatcgagagctttcccagaagaccccaccgagcatgcgactgaaactcattgccagcaacagcaccatggagcgcaagttcagcccctggatcgggggttccatcctggcctcactgggcactttccagcagatgtggatctccaagcaggaatatgaggagggcgggaagcagtgcgtggagcgaaagtgcccctgatggcactcctccccacacacctgctcccaagctcagatggaagtcccttaacccccatgccacattgcccccctcctcctttccctcttgtcctcataaatggtgatgtttctgggttgaaagaagtaaaaatgttttaagaaaaaaaag

SEQ ID NO: 450127 - DNA, 1185 bp, Homo sapiens
cgctggagtcccgccccgccaggatcccgggagctgtccggccgcctcggtgctgatcccgccaccgcccacgggccgctagcagcgcagcgggcactatgagcgggggcgtctacggcggagtggaacacacgggccaagcgggagaagctgacagagctgatgttcgagcagtacaacattcctgccttcttcttatgcaagacggctgtgctcaccgcctttgcaaacgggcggtccactggcctcgtgctggacagtggagccacccacaccacggccattccagtacatgacggctacgttctgcagcaaggcatcgtcaagtcccctctggcaggggacttcatctccatgcagtgccgggagctgttccaggagatggccattgacatcatcccaccttacatgatcgcagccaaggagcctgtccgggagggtgcccccccaaactggaagaagaaggagaagctaccccaggtctccaagtcctggcataactacatgtgtaatgaggtgatccaggacttccaggcctccgtgctgcaggtctcagactccccctacgatgaacaggtggctgcacaaatgcccacagtgcactacgagatgcccaatggctacaatacagactacggcgccgagcgactccgcatccctgagggcctgtttgatccctcgaacgtcaagggcctgtcggggaacaccatgttgggtgtgggccacgtggtgaccaccagcatcggcatgtgtgacattgatattcgcccgggcctgtacgggagtgtcattgtcaccggcgggaacacactgctgcagggcttcactgacaggctcaatcgagagctttcccagaagaccccaccgagcatgcgactgaaactcattgccagcaacagcaccatggagcgcaagttcagcccctggatcgggggttccatcctggcctcactgggcactttccagcagatgtggatctccaagcaggaatatgaggagggcgggaagcagtgcgtggagcgaaagtgcccctgatggcactcctccccacacacctgctcccaagctcagatggaagtcccttaacccccatgccacattgcccccctcctcctttccctcttgtcctcataaatggtgatgtttctgggttgaaagaagtaaaaatgttttaagaaaaaaaag

SEQ ID NO: 450128 - DNA, 984 bp, Homo sapiens
acttacccatccgatgccagctttgcaaacgggcggtccactggcctcgtgctggacagtggagccacccacaccacggccattccagtacatgacggctacgttctgcagcaaggcatcgtcaagtcccctctggcaggggacttcatctccatgcagtgccgggagctgttccaggagatggccattgacatcatcccaccttacatgatcgcagccaaggagcctgtccgggagggtgcccccccaaactggaagaagaaggagaagctaccccaggtctccaagtcctggcataactacatgtgtaatgaggtgatccaggacttccaggcctccgtgctgcaggtctcagactccccctacgatgaacaggtggctgcacaaatgcccacagtgcactacgagatgcccaatggctacaatacagactacggcgccgagcgactccgcatccctgagggcctgtttgatccctcgaacgtcaagggcctgtcggggaacaccatgttgggtgtgggccacgtggtgaccaccagcatcggcatgtgtgacattgatattcgcccgggcctgtacgggagtgtcattgtcaccggcgggaacacactgctgcagggcttcactgacaggctcaatcgagagctttcccagaagaccccaccgagcatgcgactgaaactcattgccagcaacagcaccatggagcgcaagttcagcccctggatcgggggttccatcctggcctcactgggcactttccagcagatgtggatctccaagcaggaatatgaggagggcgggaagcagtgcgtggagcgaaagtgcccctgatggcactcctccccacacacctgctcccaagctcagatggaagtcccttaacccccatgccacattgcccccctcctcctttccctcttgtcctcataaatggtgatgtttctgggttgaaagaagtaaaaatgttttaagaaaaaaaag

SEQ ID NO: 450129 - DNA, 642 bp, Homo sapiens
cgctggagtcccgccccgccaggatcccgggagctgtccggccgcctcggtgctgatcccgccaccgcccacgggccgctagcagcgcagcgggcactatgagcgggggcgtctacggcggagatgaggtgggggcgctggtctttgacattggctccttctcagtccgcgctgggtacgctggggaggactgtcccaaggctgacttccccaccacagtggggctgctggccgcggaggaggggggcgggctggagctggagggggacaaagagaagaaagggaagatcttccacatcgacaccaatgccctgcacgtgcctcgggatggagcggaggtcatgtcgcccctcaagaatggcatgatcgaggactgggagtgcttccgagccatcctggatcacacctacagcaaacacgtcaagtctgagccaaacctgcacccagtgctcatgtccgaggctccgtggaacacacgggccaagcgggagaagctgacagagctgatgttcgagcagtacaacattcctgccttcttcttatgcaagacggctgtgctcaccgcgtatcctctggactgagctgctctgactgggtggagggctggggtggggcctgtgctgagctcagctgtgatgagct

SEQ ID NO: 450130 - DNA, 189 bp, Homo sapiens
atgaggtgggggcgctggtctttgacattggctccttctcagtccgcgctgggtacgctggggaggactgtcccaaggtgagccttccagtctcctctccaaatcctaggggcttcggacccttcttcaggctttccagtgacccagggctctcccagatcgcccagaagctctgctgagcgggaatat

SEQ ID NO: 450131 - DNA, 951 bp, Homo sapiens
cgctggagtcccgccccgccaggatcccgggagctgtccggccgcctcggtgctgatcccgccaccgcccacgggccgctagcagcgcagcgggcactatgagcgggggcgtctacggcggagatgaggtgggggcgctggtctttgacattggctccttctcagtccgcgctgggtacgctggggaggactgtcccaaggctgacttccccaccacagtggggctgctggccgcggaggaggggggcgggctggagctggagggggacaaagagaagaaagggaagatcttccacatcgacaccaatgccctgcacgtgcctcgggatggagcggaggtcatgtcgcccctcaagaatggcatgatcgaggactgggagtgcttccgagccatcctggatcacacctacagcaaacacgtcaagtctgagccaaacctgcacccagtgctcatgtccgaggctccgtggaacacacgggccaagcgggagaagctgacagagctgatgttcgagcagtacaacattcctgccttcttcttatgcaagacggctgtgctcaccgcctttgcaaacgggcggtccactggcctcgtgctggacagtggagccacccacaccacggccattccagtacatgacggctacgttctgcagcaaggcatcgtcaagtcccctctggcaggggacttcatctccatgcagtgccgggagctgttccaggagatggccattgacatcatcccaccttacatgatcgcagccaaggtggggcctctggggacatggagctgccactagagtcctggccactcgccccatggccgtcaaccctctgacacatgagatatcagagcagagagcagcaggctccccagtgggtcctggctccagttcctccttttataatcgaggcatccgaaatccagacaggctgagggatatgctgagg

SEQ ID NO: 450132 - DNA, 916 bp, Homo sapiens
cccctcttgcaggcagcacagcagagcctgcagcgccaggtagctgcagagctgggaacagtgccaggaaggtgggggtgggggtcaggtgggctaggaaagggtgttcctacactgtgcccccacaggagcctgtccgggagggtgcccccccaaactggaagaagaaggagaagctaccccaggtctccaagtcctggcataactacatgtgtaatgaggtgatccaggacttccaggcctccgtgctgcaggtctcagactccccctacgatgaacagcagagtcctgctcccttctgggtagggtggctgcacaaatgcccacagtgcactacgagatgcccaatggctacaatacagactacggcgccgagcgactccgcatccctgagggcctgtttgatccctcgaacgtcaagggcctgtcggggaacaccatgttgggtgtgggccacgtggtgaccaccagcatcggcatgtgtgacattgatattcgcccgggcctgtacgggagtgtcattgtcaccggcgggaacacactgctgcagggcttcactgacaggctcaatcgagagctttcccagaagaccccaccgagcatgcgactgaaactcattgccagcaacagcaccatggagcgcaagttcagcccctggatcgggggttccatcctggcctcactgggcactttccagcagatgtggatctccaagcaggaatatgaggagggcgggaagcagtgcgtggagcgaaagtgcccctgatggcactcctccccacacacctgctcccaagctcagatggaagtcccttaacccccatgccacattgcccccctcctcctttccctcttgtcctcataaatggtgatgtttctgggttgaaagaagtaaaaatgttttaagaaaaaaaag

SEQ ID NO: 450133 - DNA, 912 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgtgagtggcacacggggtccgcgagcggcgcgccccggccctggccctgcgtacgcctgtcctccgcgcacggcgggctctgcctttctgtctcggtgtccccggtgtctccccgcctcggggggtctctccgtgtttctctccccagcacttctctgtcgctcttgctgtctccgtcttcactctctgccccccggccccggagcgcgacgtccacggccaggccgggacggaccgtgcacaccctcgttcccggtgtcctcgtcgcgctcccggaacaacctggctgcgggcgggacaggtggggcgggcgccgcaggggagggcgggcggccctgctgcgctggacagccccggccccgccgcttctggcgacctgactgtcccctgtgaccacaggaaggaaggggctgcagcagggcgaagaggaacacggaggctgtggcgtggtgagggtgtgaacgccgggctcgaatccgcgtccgggcccgaatccgcttcccgtcccgaatccgcgtcccggccatccgcgtgtggtccaggcggtctacctggcccctctgacctcggcttctcccttggtgaaatggggacatgaatgaccaaactggtctaaggattaaatgatgtgggtgaaaagcacttagtacatattgggcgcacacttcgtaggggcgttcgtcactgcctataaagattctaaacgtgggccaggtgcggtggctcacacctgtaatcccagcactttg

SEQ ID NO: 450134 - DNA, 465 bp, Homo sapiens
ataaaaagacctccagataggcagacagacagatggaccaccaacctggacagacagccaaagcttcagagatacagtccacaggtggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgca

SEQ ID NO: 450135 - DNA, 4456 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450136 - DNA, 4375 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450137 - DNA, 3634 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450138 - DNA, 4265 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450139 - DNA, 4397 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagacccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450140 - DNA, 3846 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450141 - DNA, 4340 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggacccccccctaagttagttacctgg

SEQ ID NO: 450142 - DNA, 1484 bp, Homo sapiens
accgggtatttgtcacgataaccctgcctcctctcccgcctctcctcagcacacagatccagaaccacaaatatcgatatttgtgcttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450143 - DNA, 2843 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450144 - DNA, 2938 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagacgagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450145 - DNA, 1528 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggatcctacgcgttctgcggcctgtgctagatcatgaggagcagtacaggttaatgtgactacgcggtggttcagatttctcattatacccaat

SEQ ID NO: 450146 - DNA, 1317 bp, Homo sapiens
ggctccgtcaccctatcctacccaaactccacgtttctcaccttatctgctgacagatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcgggtaggtgccctctgcccccaggtttcatgtccttgtgggaggagggaggagggatcttgctagctcctccttgaccccaggacccgagggtccagctcttggagtgaccttattgtagctctgtgggaagccccattgttcctctaagtttttgttgatatgttattcatcccccagtgttggcaacccctctcctgctgggcttcccagccatttcacaccttagaccataaggccctattctgactgcttcccctgtaggctctgatctctctttccacctctcttccctttattcactccactctaacaactctggtctctgctgttcccatgttccagggatggctctgcctcagggtctgtgccttggctattccttcagcctaggacatccttccctgtggcttgctctatcacctccttcaggtctttgctcaaatggtaattcctcaatgagaccttccggggtgggtcttcacaccattttaaactctcagcacttccattctccctcccttgtcctacttttccttctttcttcacagttcttatgaactcctaacacactggataatctacaaatgtattatgtacattgtttatgcttaatctccctgatttagaaggtaagatccacaaggccagggatttttgttttgcctgttaacataaattagttactaaataaataaatgcatgtcaatattgaaggctgaaggcacatagcttcatgtggtttctacattcttgcctactccatggatggggtaggggttccctggggtgactagctgatggtggaggctgtatgatctgtagtcttgtctctttctcattcctgattttggtaatttgtgttctctctctctctctgtctcatctctctatttcgctatctcttttttcatgctcctgcctgttttttgtaaac

SEQ ID NO: 450147 - DNA, 258 bp, Homo sapiens
gtgagggttggggtcacggaaggaggtggactgggagtggccaggggtgggccgcagaatctcagtcgtgaattcggccttcaccagggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctc

SEQ ID NO: 450148 - DNA, 392 bp, Homo sapiens
ggagacttaaggcccttgtccttgcggccatcccttcctgtcttctatgccacttccgcattcttttgttcagtagacgttgacacagaaatgaccacccctcaaaccaacactctgccccaaattaccctccaggctgaccccgttcctccttcatccccctaacttgcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcg

SEQ ID NO: 450149 - DNA, 2800 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgca

SEQ ID NO: 450150 - DNA, 4288 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450151 - DNA, 3313 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450152 - DNA, 3883 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450153 - DNA, 4271 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagcaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450154 - DNA, 4708 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccgatccagagatagatgactcattatccagcaacacagaggtcagcaccgacctcaccagcagcaggctcacaggagtggcaggggcattgggagagtgggaggcagcacagggtcagctctttcacgaaaacagattttttttttttggcgacccgcgtttattttattaggaaggaaacaaccaagcaccccatgctcctgcccggcactcccggtgggaacatgccaaacagccgggcgatcgcacccagcc

SEQ ID NO: 450155 - DNA, 3011 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450156 - DNA, 2979 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagacgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccga

SEQ ID NO: 450157 - DNA, 2765 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgttcagatataatctgaagattctgggaatcaagaggctctgcaggggatccatcaggaccctcacccccatccccaaatgccccatctaaaaggggttgtggtcaggacctgaccaggcacactctgattctcttgtcagtgcgggttgtgggcgaacaggcgtcctgtgcaccgtggattatgtgaggcagctgctcctgacccaggtacgatacaggcatcctgtgtgtgcagtgtgctgcccatgaccacgtgtcctgctcaagtgccttgtctgtctgccccagatgatcccacctgacttcagtctctttgatgtggtccttaagatgaggaagcagcggcctgcggccgtgcagacagaggtgaaccctgggtctcctaatcttcagggacagtggcccactgctgtcatttgcccctgccttcccttcttgatggtccctcaccccaacaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcagggcgctagggacacagaagcgaggcctccaacccaaggagccctccctcccatctagcgcaccgcctcggcgggaaggaagcccgtggtttgcgcgctgagcagcctccccactcccgccctgcccagcgccgccgtttcacttcctcccggccctccctgcctgcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagactttttaagatacattcagggacggatcccccct

SEQ ID NO: 450158 - DNA, 1418 bp, Homo sapiens
tccgcctcccgcggcgtccacactcgccgcgcgcgcggcggcgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtgatcctgatggcctgtcgagagatagagaatgggcgggtaggtgccctctgcccccaggtttcatgtccttgtgggaggagggaggagggatcttgctagctcctccttgaccccaggacccgagggtccagctcttggagtgaccttattgtagctctgtgggaagccccattgttcctctaagtttttgttgatatgttattcatcccccagtgttggcaacccctctcctgctgggcttcccagccatttcacaccttagaccataaggccctattctgactgcttcccctgtaggctctgatctctctttccacctctcttccctttattcactccactctaacaactctggtctctgctgttcccatgttccagggatggctctgcctcagggtctgtgccttggctattccttcagcctaggacatccttccctgtggcttgctctatcacctccttcaggtctttgctcaaatggtaattcctcaatgagaccttccggggtgggtcttcacaccattttaaactctcagcacttccattctccctcccttgtcctacttttccttctttcttcacagttcttatgaactcctaacacactggataatctacaaatgtattatgtacattgtttatgcttaatctccctgatttagaaggtaagatccacaaggccagggatttttgttttgcctgttaacataaattagttactaaataaataaatgcatgtcaatattgaaggctgaaggcacatagcttcatgtggtttctacattcttgcctactccatggatggggtaggggttccctggggtgactagctgatggtggaggctgtatgatctgtagtcttgtctctttctcattcctgattttggtaatttgtgttctctctctctctctgtctcatctctctatttcgctatctcttttttcatgctcctgcctgttttttgtaaac

SEQ ID NO: 450159 - DNA, 648 bp, Homo sapiens
ggctccgtcaccctatcctacccaaactccacgtttctcaccttatctgctgacagatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtcagcacttgggggtgcggcacaatggtggggtcaacatctaagtaccccctcggcagtttccctggccccctcacccaaatcaccttcctctcccctgaccctccttgtctaggtgatcctgatggcctgtcgagagatagagaatgggcgggtaggtgccctctgcccccaggtttcatgtccttgtgggaggagggaggagggatcttgctagctcctccttgaccccaggacccgagggtccagctcttggagtgaccttattgtagctctgtgggaagccccattgttcctctaagtttttgttgatatgttattcatcccccagtgttaagggctcccggagggttaagggctcccggagggttaagggctcccggagggttaagggctcccggagggttaagggctcccgg

SEQ ID NO: 450160 - DNA, 759 bp, Homo sapiens
  misc_feature (17)..(17): n is a, c, g, or t
  misc_feature (21)..(21): n is a, c, g, or t
  misc_feature (30)..(30): n is a, c, g, or t
agaattaggcttaggtngagnctgggtgantcggccgaggaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaata

SEQ ID NO: 450161 - DNA, 779 bp, Homo sapiens
ttacgtggttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaatacaattgtctcgttgaaaaaaaaaacggg

SEQ ID NO: 450162 - DNA, 819 bp, Homo sapiens
  misc_feature (25)..(25): n is a, c, g, or t
  misc_feature (747)..(747): n is a, c, g, or t
gggctaggtacgaggctgggtgggnaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataccngggctctttcggggcggaaagttgaatggcatgtctagttctgcccttttgtcaagggatgcgccaagagaa

SEQ ID NO: 450163 - DNA, 968 bp, Homo sapiens
ttacgtggttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataaaaaaaactcggggctcttagccggcgcgcaaacacgttcgacgggcctggcctaggggtcccgcccgctttttgcacaaggggaacggcggcccagggggggtaatcgaaaccgtcactctctagaaggcggaaaggaagggaggcacagaaaaaaaaacggggaaacaacaaaaaaaaacaacaagaaaaagagaacgcacgagccaactgataa

SEQ ID NO: 450164 - DNA, 826 bp, Homo sapiens
  misc_feature (754)..(754): n is a, c, g, or t
ttacgtggttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataccngggctctttcggggcggaaagttgaatggcatgtctagttctgcccttttgtcaagggatgcgccaagagaa

SEQ ID NO: 450165 - DNA, 697 bp, Homo sapiens
ttacgtggttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcaggctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaata

SEQ ID NO: 450166 - DNA, 833 bp, Homo sapiens
tttttttgttatttagtttttatttcataatcataaacttaactctgcaatccagctaggcatgggagggaacaaggaaaacatggaacccaaagggaactgcagcgagagcacaaagattctaggatactgcgagcaaatggggtggaggggtgctctcctgagctacagaaggaatgatctggtggttaagataaaacacaagtcaaacttattcgagttgtccacagtcagcaatggtgatcttcttgctggtcttgccattcctggacccaaagcgctccatggctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaata

SEQ ID NO: 450167 - DNA, 751 bp, Homo sapiens
ttacgtggttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaata

SEQ ID NO: 450168 - DNA, 744 bp, Homo sapiens
  misc_feature (25)..(25): n is a, c, g, or t
gggctaggtacgaggctgggtgggnaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaata

SEQ ID NO: 450169 - DNA, 872 bp, Homo sapiens
ttacgtggttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaatatgtcagatgacacaataaaactcggacatcatgtgggggcaaacaacggctttcaagtgcatgcccaagcggtccggaccggtttggtaaacggggaatctgcggccctagggcgtattca

SEQ ID NO: 450170 - DNA, 862 bp, Homo sapiens
ttacgtggttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaatatacaatgtcacacgaaaaaaaacccgggcttaatcccggggcggaaacagggttcttaaggccttgtccttgctgttcctggcccttttctgtcacacgggaaactgcggg

SEQ ID NO: 450171 - DNA, 605 bp, Homo sapiens
ttacgtggttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtcacacgcaacttggcctccctgtacgaaaggacaagagaaataaggcctacttcacaaagcgccttcccccgtaaatgatatcatctcaactatattatagccacacccaaccac

SEQ ID NO: 450172 - DNA, 593 bp, Homo sapiens
ttacgtggttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaata

SEQ ID NO: 450173 - DNA, 2526 bp, Homo sapiens
ccaggcgctgcgcggctgctctggcgtccagtcctacccgcaacccgcttctccgactttcctgctcctctgctgccttcgtttctggtcctcggccgtcctcgccgcccgcccagaggagtccccgcgcccgccaagaagccgctttccgctggcccgcagccgccgcgacttcggcacagtttctccctctggctagtctcccaaacggccgctcctcgcccgcgggaagaccaggctgcgaccgcgaacgcccgatcctctccaggagccgcagcgagcgcccggcggccacgccccgcgaccacaccccggcggctctcggcccagcgcgcctgccttcgccgcccgccgtcgctcctcgcccgctgcacgacgacgcgacgcccctgctgcaggcggcggacccgaccggacccagacccagacgcaagatggcgacggccgcgtgactgcctcagcgtccccgagctcggctccgagtgcacctacggactgactgtgggggcagagaagggcgagatcaggactctgtctttgttaatcgtgactgcatgaaggtcgcctccctcgggcctacttggtgggagtgtctggtattgttctaaggccaggagcacggtgagccacagtctgttggtagaatttggcgtcttgatagttgagaaaatggcgatgacactgttggaagactggtgccgggggatggatgtgaactcccagagagctctgttagtctggggcatcccagtgaactgtgatgaggctgaaatcgaagagaccctccaggctgcgatgccccaggtctcctaccgaatgcttgggagaatgttctggagggaagaaaatgcgaaagcagccttattagagctcactggcgctgtagattacgccgcgatccccagggagatgccgggcaaaggaggggtctggaaagtgttatttaagcccccaacttctgatgctgaatttttagaaagattgcacctcttcctagctagagaggggtggaccgtgcaagatgttgcccgtgtccttgggtttcagaaccctactccgaccccgggcccagagatgccagcagagatgctaaactatattttggataatgttattcagcctcttgttgagtccatatggtacaagaggctgacacttttctcggggagggacatcccagggcctggagaggaaacctttgatccctggctggagcacactaatgaggtcctagaggagtggcaggtgtccgatgtagaaaagaggcggcggttgatggagagtcttagaggccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccaaacctctttcagttgctggtgcagatccgtgaggaggaagccaaggaggaggaggaggaggctgaggccacccttctgcagttaggcctggaagggcacttctgagtgccaggaaaggcagctttagtgcagacctagatcacagctacttttcttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgaaattgcatgttcagatgtttactacgaggcctggctcacaggaagtgttcagtaaaagtatgcactgttagattactgataacgcggatagatttttgtttaccataaattgttccagatttatattaatggaaggaagtgtgcatttattagctattactcaactttacaatgcaaacatcttatttctcatctttaaacatgtcgaccagtttaattgaaaagtattctgagactgcaaaatggggtgttaaaaaatactgcagttacggagctgtgtaaaccagtttctcattgcataagatacagatgtaaattgcatggagaggttgatatgcacctgtacagtaattcactcccccatttcacatctttgtcagagaatagttcttgttcatactgagtgttctaaatttgaagttatatatacaaattaaaatattttaaaaattc

SEQ ID NO: 450174 - DNA, 781 bp, Homo sapiens
tgggaagtttgatcccagacagactgctgttaagaggggccagcccgttgggctcagctgtcctgaggactcgcatcccgcctgggagatgcagctgtcactgggtttctccctctctgttgtcctggcctcgtccctggcagttggcggggccttgtacgcgtacagccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccaaacctctttcagttgctggtgcagatccgtgaggaggaagccaaggaggaggaggaggaggctgaggccacccttctgcagttaggcctggaagggcacttctgagtgccaggaaaggcagctttagtgcagacctagatcacagctacttttcttgtccctgtgggccttgtacgcgtacaaggccccgtgggagactggtcttcactctcaatgcagccgccacatagatctcggccagcgtcgccacagacacggcatcccctgcacactctgcca

SEQ ID NO: 450175 - DNA, 2266 bp, Homo sapiens
ccgagcccctcgctggctccacggcaaccgctcgacccccgcgagccgccggagcaggcgtgcctcgcgccggctgggacaccgttgccatggagacgcccgagcagctccgccgcgggggcgggacggggcggggcggggcggacgccgctcgccggctggccccatcctccactgcagcagtaacgtcgcggcgggttgcgggtaggactggacgccagggcagccgcgcagcgcctgaaccgctgcgggccgccgcggccgccccttcccaccctcgcctctgctgtctccagcctcgtcgcctccctcgggcctacttggtgggagtgtctggtattgttctaaggccaggagcacggtgagccacagtctgttggtagaatttggcgtcttgatagttgagaaaatggcgatgacactgttggaagactggtgccgggggatggatgtgaactcccagagagctctgttagtctggggcatcccagtgaactgtgatgaggctgaaatcgaagagaccctccaggctgcgatgccccaggtctcctaccgaatgcttgggagaatgttctggagggaagaaaatgcgaaagcagccttattagagctcactggcgctgtagattacgccgcgatccccagggagatgccgggcaaaggaggggtctggaaagtgttatttaagcccccaacttctgatgctgaatttttagaaagattgcacctcttcctagctagagaggggtggaccgtgcaagatgttgcccgtgtccttgggtttcagaaccctactccgaccccgggcccagagatgccagcagagatgctaaactatattttggataatgttattcagcctcttgttgagtccatatggtacaagaggctgacacttttctcggggagggacatcccagggcctggagaggaaacctttgatccctggctggagcacactaatgaggtcctagaggagtggcaggtgtccgatgtagaaaagaggcggcggttgatggagagtcttagaggccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccaaacctctttcagttgctggtgcagatccgtgaggaggaagccaaggaggaggaggaggaggctgaggccacccttctgcagttaggcctggaagggcacttctgagtgccaggaaaggcagctttagtgcagacctagatcacagctacttttcttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgaaattgcatgttcagatgtttactacgaggcctggctcacaggaagtgttcagtaaaagtatgcactgttagattactgataacgcggatagatttttgtttaccataaattgttccagatttatattaatggaaggaagtgtgcatttattagctattactcaactttacaatgcaaacatcttatttctcatctttaaacatgtcgaccagtttaattgaaaagtattctgagactgcaaaatggggtgttaaaaaatactgcagttacggagctgtgtaaaccagtttctcattgcataagatacagatgtaaattgcatggagaggttgatatgcacctgtacagtaattcactcccccatttcacatctttgtcagagaatagttcttgttcatactgagtgttctaaatttgaagttatatatacaaattaaaatattttaaaaattc

SEQ ID NO: 450176 - DNA, 2735 bp, Homo sapiens
ccgagcccctcgctggctccacggcaaccgctcgacccccgcgagccgccggagcaggcgtgcctcgcgccggctgggacaccgttgccatggagacgcccgagcagctccgccgcgggggcgggacggggcggggcggggcggacgccgctcgccggctggccccatcctccactgcagcagtaacgtcgcggcgggttgcgggtaggactggacgccagggcagccgcgcagcgcctgaaccgctgcgggccgccgcggccgccccttcccaccctcgcctctgctgtctccagcctcgcttctccgactttcctgctcctctgctgccttcgtttctggtcctcggccgtcctcgccgcccgcccagaggagtccccgcgcccgccaagaagccgctttccgctggcccgcagccgccgcgacttcggcacagtttctccctctggctagtctcccaaacggccgctcctcgcccgcgggaagaccaggctgcgaccgcgaacgcccgatcctctccaggagccgcagcgagcgcccggcggccacgccccgcgaccacaccccggcggctctcggcccagcgcgcctgccttcgccgcccgccgtcgctcctcgcccgctgcacgacgacgcgacgcccctgctgcaggcggcggacccgaccggacccagacccagacgcaagatggcgacggccgcgtgactgcctcagcgtccccgagctcggctccgagtgcacctacggactgactgtgggggcagagaagggcgagatcaggactctgtctttgttaatcgtgactgcatgaaggtcgcctccctcgggcctacttggtgggagtgtctggtattgttctaaggccaggagcacggtgagccacagtctgttggtagaatttggcgtcttgatagttgagaaaatggcgatgacactgttggaagactggtgccgggggatggatgtgaactcccagagagctctgttagtctggggcatcccagtgaactgtgatgaggctgaaatcgaagagaccctccaggctgcgatgccccaggtctcctaccgaatgcttgggagaatgttctggagggaagaaaatgcgaaagcagccttattagagctcactggcgctgtagattacgccgcgatccccagggagatgccgggcaaaggaggggtctggaaagtgttatttaagcccccaacttctgatgctgaatttttagaaagattgcacctcttcctagctagagaggggtggaccgtgcaagatgttgcccgtgtccttgggtttcagaaccctactccgaccccgggcccagagatgccagcagagatgctaaactatattttggataatgttattcagcctcttgttgagtccatatggtacaagaggctgacacttttctcggggagggacatcccagggcctggagaggaaacctttgatccctggctggagcacactaatgaggtcctagaggagtggcaggtgtccgatgtagaaaagaggcggcggttgatggagagtcttagaggccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccaaacctctttcagttgctggtgcagatccgtgaggaggaagccaaggaggaggaggaggaggctgaggccacccttctgcagttaggcctggaagggcacttctgagtgccaggaaaggcagctttagtgcagacctagatcacagctacttttcttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgatgttcagtaaaagtatgcactgttagattactgataacgcggatagatttttgtttaccataaattgttccagatttatattaatggaaggaagtgtgcatttattagctattactcaactttacaatgcaaacatcttatttctcatctttaaacatgtcgaccagtttaattgaaaagtattctgagactgcaaaatggggtgttaaaaaatactgcagttacggagctgtgtaaaccagtttctcattgcataagatacagatgtaaattgcatggagaggttgatatgcacctgtacagtaattcactcccccatttcacatctttgtcagagaatagttcttgttcatactgagtgttctaaatttgaagttatatatacaaattaaaatattttaaaaattc

SEQ ID NO: 450177 - DNA, 2797 bp, Homo sapiens
ccgagcccctcgctggctccacggcaaccgctcgacccccgcgagccgccggagcaggcgtgcctcgcgccggctgggacaccgttgccatggagacgcccgagcagctccgccgcgggggcgggacggggcggggcggggcggacgccgctcgccggctggccccatcctccactgcagcagtaacgtcgcggcgggttgcgggtaggactggacgccagggcagccgcgcagcgcctgaaccgctgcgggccgccgcggccgccccttcccaccctcgcctctgctgtctccagcctcgcttctccgactttcctgctcctctgctgccttcgtttctggtcctcggccgtcctcgccgcccgcccagaggagtccccgcgcccgccaagaagccgctttccgctggcccgcagccgccgcgacttcggcacagtttctccctctggctagtctcccaaacggccgctcctcgcccgcgggaagaccaggctgcgaccgcgaacgcccgatcctctccaggagccgcagcgagcgcccggcggccacgccccgcgaccacaccccggcggctctcggcccagcgcgcctgccttcgccgcccgccgtcgctcctcgcccgctgcacgacgacgcgacgcccctgctgcaggcggcggacccgaccggacccagacccagacgcaagatggcgacggccgcgtgactgcctcagcgtccccgagctcggctccgagtgcacctacggactgactgtgggggcagagaagggcgagatcaggactctgtctttgttaatcgtgactgcatgaaggtcgcctccctcgggcctacttggtgggagtgtctggtattgttctaaggccaggagcacggtgagccacagtctgttggtagaatttggcgtcttgatagttgagaaaatggcgatgacactgttggaagactggtgccgggggatggatgtgaactcccagagagctctgttagtctggggcatcccagtgaactgtgatgaggctgaaatcgaagagaccctccaggctgcgatgccccaggtctcctaccgaatgcttgggagaatgttctggagggaagaaaatgcgaaagcagccttattagagctcactggcgctgtagattacgccgcgatccccagggagatgccgggcaaaggaggggtctggaaagtgttatttaagcccccaacttctgatgctgaatttttagaaagattgcacctcttcctagctagagaggggtggaccgtgcaagatgttgcccgtgtccttgggtttcagaaccctactccgaccccgggcccagagatgccagcagagatgctaaactatattttggataatgttattcagcctcttgttgagtccatatggtacaagaggctgacacttttctcggggagggacatcccagggcctggagaggaaacctttgatccctggctggagcacactaatgaggtcctagaggagtggcaggtgtccgatgtagaaaagaggcggcggttgatggagagtcttagaggccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccaaacctctttcagttgctggtgcagatccgtgaggaggaagccaaggaggaggaggaggaggctgaggccacccttctgcagttaggcctggaagggcacttctgagtgccaggaaaggcagctttagtgcagacctagatcacagctacttttcttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgaaattgcatgttcagatgtttactacgaggcctggctcacaggaagtgttcagtaaaagtatgcactgttagattactgataacgcggatagatttttgtttaccataaattgttccagatttatattaatggaaggaagtgtgcatttattagctattactcaactttacaatgcaaacatcttatttctcatctttaaacatgtcgaccagtttaattgaaaagtattctgagactgcaaaatggggtgttaaaaaatactgcagttacggagctgtgtaaaccagtttctcattgcataagatacagatgtaaattgcatggagaggttgatatgcacctgtacagtaattcactcccccatttcacatctttgtcagagaatagttcttgttcatactgagtgttctaaataaccgtatataacagactgaacagctcggccaccggcgcgcgcggccgagccgggg

SEQ ID NO: 450178 - DNA, 4471 bp, Homo sapiens
gtggttatggagcagctgccgggggtgccaccaggccccccccaccccgttcgaccgccacccccgcctccaccacccatgcccctgcagctcgaggcccacctccgcagccatggcctggagcccgcggcccccagcccccgcctgcgacccgaggagagcctggatccgccaggcgccatgcaggaattgctcggggctctggagccgctgcccccggcgcctggggatactggcgtaggcccaccaaactcggagggcaaggatcccgcaggcgcctaccgcagccccagcccgcaaggcaccaaggcgccgcgtttcgtgccgctcacctccatctgcttccctgactccttgctccaagacgaggagcgcagcttcttccccaccatggaggagatgttcggtggaggggccgcggacgactacggcaaggccgggccacctgaggacgagggggaccccaaggctggcgctgggccaccccccggcccccctgcttatgatccctatgggccctactgtcctggccgggcgtcgggagccgggcccgagacaccgggcctgggcctggaccccaacaaaccgcctgaactgccctccacggtcaacgccgagccgctgggcctgatccagagtggcccccaccaggcggcgccaccacccccgcctccgccaccgccgcctcccgcgccggcctccgaacccaagggtggcctcacctcgcccatcttctgctctaccaagccaaagaagctgctcaagacatcctccttccacctgctgcggcgccgcgacccacccttccagacccccaagaagctgtacgcccaggagtacgagttcgaggcggacgaggacaaggccgatgttcccgccgacatccgcctcaacccccggcgcttgcctgacctggtctccagctgccgctcccgtccggccctctcgccactgggggacatcgacttctgcccacccaacccaggacccgatggcccccggcgccgtggccgcaagcccacgaaggcgaaacgtgatgggccaccccggccacgggggaggccccggatccgccccctggaggtcccgaccactgcggggcccgcctcggcctccacgcccaccgatggcgccaagaaaccccggggccggggccgaggccggggtcgaaaggctgaggaggcagggggcacccggttggagcccctgaagccacttaagatcaagctgtctgtgcccaaggctggcgagggtctgggaacctcatcgggtgatgccatatcaggcactgaccacaacagcctggactcgagcctgactcgggagaagatcgaggccaagattaaggaggtggaggagaagcagccggagatgaagtcgggtttcatggcctccttcttggacttcctcaagtcaggcaagcgccacccaccactctaccaggcgggcctgacgcctccgctcagccctcccaagagtgtgccaccctctgtgccagcccgaggcctgcagccccagccccctgccacccctgctgtgccacatcccccaccttccggagcctttgggcttgggggcgccctggaggctgcagagagtgagggtctggggcttggctgcccttcaccctgcaagcggcttgatgaggagctgaagcggaacctcgagacgctgccctccttctcctcggatgaggaagactctgtcgccaagaaccgagacctgcaggagagcatctcctccgccatctctgccctcgatgacccaccccttgctgggccaaaagacacttccaccccagatgggccgcccttggcccccgcggctgcagttccagggccaccccctcttccggggctccccagtgccaacagcaatggcactcccgagcccccgctgctggaggagaaacccccacccactccacctcctgccccgactcctcagcctcagcctccgccaccccctccgccgccacagccagccctgccctcgccacccccgctggtggcccccacgcccagctcaccaccgccaccgccgctgccgccgccacctccaccagccatgccctcgcctccaccaccacccccaccagccgctgccccactggctgctcctcctgaggagcccgccgccccgtctcccgaagaccccgagctgccggacacccggcccctgcatctggccaaaaagcaggagacggcggcagtgtgtggggagacggacgaggaggccggcgagagtggcggagagggcatcttccgggaacgggacgagttcgtcatccgtgctgaggacatcccttccctcaagctggcgttgcagacggggcgtgaacccccacccatctggcgagtccagaaggcccttctgcagaaattcactccggagatcaaggacggccagaggcagttttgtgccaccagtaattatttggggtattttggggatgcaaaaaatcggtaccagcgcctctatgtaaagttcctggaaaatgtcaataagaaggactacgtgagggtctgtgctcggaaaccctggcatcggcccccagtgccagtcagacgctctgggcaggccaagaaccccgtatctgctgggggtagctctgcacctccccctaaggccccagcaccacctcccaagcctgagacccctgaaaagacgacatctgagaagcccccagagcagactcctgagacggccatgcctgagccccctgcccccgagaagccctccctcctgcggcctgttgagaaggaaaaggagaaggagaaggtgacacgtggagagcggccattgcggggtgagcgggccaccagcggacggcagacacggccagagcggagtctcgccacgggacaacctgccacatcccggctgcccaaagcccggcctaccaaggtgaaggctgaaccgccccctaagaagaggaagaaatggctgaaggaggcaggcggcaacgctacagcaggcgggggcccaccaggcagctcctcggactcggagtcctcccctggagcccccagcgaggacgagcgggcagtacctgggcgtctgctcaaaaccagggcgatgcgggagatgtaccggagctacgtggagatgttggtgagcacagcacttgacccagacatgatccaggccctggaggacacgcatgacgagctgtacctgccccccatgcggaagatagacggcctgctgaatgagcacaagaagaaagtcctgaagcggctgtcgctaagcccagccctgcaggatgctctgcacacgttcccacagctgcaagtggagcagagtggggagggctctccggaagagggggctgtgcggctgcggcctgctggggaaccctacaaccgcaagacgctcagcaagctcaagaggagcgtggtcagagcccaggagttcaaggttgagctggaaaagtcgggatactatacactctaccattcgctccaccactataaataccacaccttcctgcgctgccgggaccagaccctggccatcgagggcggcgccgaggacctgggccaggaggaggtggtccagcagtgcatgcggaaccagccgtggctggaacagctctttgactccttcagtgacctgctggcccaagcacaggcccacagccgctgcgggtgaccccgccccagcttgtgaggggggcgcctcctccatgaaccgagaattgggacagaaccgtgtcctcaggagctaacacctgggctccatcgccggggaaagggggtcatgggtcagggtgtgtctgtgctgccccctccagggcagggttcaaagtccgactccccgcgcccgccaagaagccgctttccgctggcccgcagccgccgcgacttcggcacagtttctccctctggctagtctcccaaacggtttccctctccccttgccccgaccccccctccacagccacagcccccgccccctccaccttgtacataatgtataggaaaagtctatgtatggctggggggggtggggtggcttcagagagctgggggaccccttccccccaagtcccccctgcaggccaagatctttgctaaaggccattccctccgcagggcatttggcgtcgggtgggaggggaaaacgcatcttgttaattatttttaatcttatttattgtacatacctggggcaggggcttggggaggtggaggggggagaagggtcccctctctctgcccctcccactccttttctacggcgatttgtctgtgtctggcccccacccactgcccatcccccattgttgtctggatgtggttctattttttatcggtctcctttcccctcctccccgttctcgcccccgccccaccccctgctcccactaccctttgtctcttgctctttcttgggcttctgtacaactcaacttgtatacactgtgtacacacaaccagccaaacgaaaacccaacggcaaacacttt

SEQ ID NO: 450179 - DNA, 2780 bp, Homo sapiens
ccgagcccctcgctggctccacggcaaccgctcgacccccgcgagccgccggagcaggcgtgcctcgcgccggctgggacaccgttgccatggagacgcccgagcagctccgccgcgggggcgggacggggcggggcggggcggacgccgctcgccggctggccccatcctccactgcagcagtaacgtcgcggcgggttgcgggtaggactggacgccagggcagccgcgcagcgcctgaaccgctgcgggccgccgcggccgccccttcccaccctcgcctctgctgtctccagcctcgcttctccgactttcctgctcctctgctgccttcgtttctggtcctcggccgtcctcgccgcccgcccagaggagtccccgcgcccgccaagaagccgctttccgctggcccgcagccgccgcgacttcggcacagtttctccctctggctagtctcccaaacggccgctcctcgcccgcgggaagaccaggctgcgaccgcgaacgcccgatcctctccaggagccgcagcgagcgcccggcggccacgccccgcgaccacaccccggcggctctcggcccagcgcgcctgccttcgccgcccgccgtcgctcctcgcccgctgcacgacgacgcgacgcccctgctgcaggcggcggacccgaccggacccagacccagacgcaagatggcgacggccgcgtgactgcctcagcgtccccgagctcggctccgagtgcacctacggactgactgtgggggcagagaagggcgagatcaggactctgtctttgttaatcgtgactgcatgaaggtcgcctccctcgggcctacttggtgggagtgtctggtattgttctaaggccaggagcacggtgagccacagtctgttggtagaatttggcgtcttgatagttgagaaaatggcgatgacactgttggaagactggtgccgggggatggatgtgaactcccagagagctctgttagtctggggcatcccagtgaactgtgatgaggctgaaatcgaagagaccctccaggctgcgatgccccaggtctcctaccgaatgcttgggagaatgttctggagggaagaaaatgcgaaagcagccttattagagctcactggcgctgtagattacgccgcgatccccagggagatgccgggcaaaggaggggtctggaaagtgttatttaagcccccaacttctgatgctgaatttttagaaagattgcacctcttcctagctagagaggggtggaccgtgcaagatgttgcccgtgtccttgggtttcagaaccctactccgaccccgggcccagagatgccagcagagatgctaaactatattttggataatgttattcagcctcttgttgagtccatatggtacaagaggctgacacttttctcggggagggacatcccagggcctggagaggaaacctttgatccctggctggagcacactaatgaggtcctagaggagtggcaggtgtccgatgtagaaaagaggcggcggttgatggagagtcttagaggccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccaaacctctttcagttgctggtgcagatccgtgaggaggaagccaaggaggaggaggaggaggctgaggccacccttctgcagttaggcctggaagggcacttctgagtgccaggaaaggcagctttagtgcagacctagatcacagctacttttcttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgaaattgcatgttcagatgtttactacgaggcctggctcacaggaagtgttcagtaaaagtatgcactgttagattactgataacgcggatagatttttgtttaccataaattgttccagatttatattaatggaaggaagtgtgcatttattagctattactcaactttacaatgcaaacatcttatttctcatctttaaacatgtcgaccagtttaattgaaaagtattctgagactgcaaaatggggtgttaaaaaatactgcagttacggagctgtgtaaaccagtttctcattgcataagatacagatgtaaattgcatggagaggttgatatgcacctgtacagtaattcactcccccatttcacatctttgtcagagaatagttcttgttcatactgagtgttctaaatttgaagttatatatacaaattaaaatattttaaaaattc

SEQ ID NO: 450180 - DNA, 2883 bp, Homo sapiens
ccgagcccctcgctggctccacggcaaccgctcgacccccgcgagccgccggagcaggcgtgcctcgcgccggctgggacaccgttgccatggagacgcccgagcagctccgccgcgggggcgggacggggcggggcggggcggacgccgctcgccggctggccccatcctccactgcagcagtaacgtcgcggcgggttgcgggtaggactggacgccagggcagccgcgcagcgcctgaaccgctgcgggccgccgcggccgccccttcccaccctcgcctctgctgtctccagcctcgcttctccgactttcctgctcctctgctgccttcgtttctggtcctcggccgtcctcgccgcccgcccagaggagtccccgcgcccgccaagaagccgctttccgctggcccgcagccgccgcgacttcggcacagtttctccctctggctagtctcccaaacggccgctcctcgcccgcgggaagaccaggctgcgaccgcgaacgcccgatcctctccaggagccgcagcgagcgcccggcggccacgccccgcgaccacaccccggcggctctcggcccagcgcgcctgccttcgccgcccgccgtcgctcctcgcccgctgcacgacgacgcgacgcccctgctgcaggcggcggacccgaccggacccagacccagacgcaagatggcgacggccgcgtgactgcctcagcgtccccgagctcggctccgagtgcacctacggactgactgtgggggcagagaagggcgagatcaggactctgtctttgttaatcgtgactgcatgaaggtcgcctccctcgggcctacttggtgggagtgtctggtattgttctaaggccaggagcacggtgagccacagtctgttggtagaatttggcgtcttgatagttgagaaaatggcgatgacactgttggaagactggtgccgggggatggatgtgaactcccagagagctctgttagtctggggcatcccagtgaactgtgatgaggctgaaatcgaagagaccctccaggctgcgatgccccaggtctcctaccgaatgcttgggagaatgttctggagggaagaaaatgcgaaagcagccttattagagctcactggcgctgtagattacgccgcgatccccagggagatgccgggcaaaggaggggtctggaaagtgttatttaagcccccaacttctgatgctgaatttttagaaagattgcacctcttcctagctagagaggggtggaccgtgcaagatgttgcccgtgtccttgggtttcagaaccctactccgaccccgggcccagagatgccagcagagatgctaaactatattttggataatgttattcagcctcttgttgagtccatatggtacaagaggctgacacttttctcggggagggacatcccagggcctggagaggaaacctttgatccctggctggagcacactaatgaggtcctagaggagtggcaggtgtccgatgtagaaaagaggcggcggttgatggagagtcttagaggccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccaaacctctttcagttgctggtgcagatccgtgaggaggaagccaaggaggaggaggaggaggctgaggccacccttctgcagttaggcctggaagggcacttctgagtgccaggaaaggcagctttagtgcagacctagatcacagctacttttcttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgaaattgcatgttcagatgtttactacgaggcctggctcacaggaagtgttcagtaaaagtatgcactgttagattactgataacgcggatagatttttgtttaccataaattgttccagatttatattaatggaaggaagtgtgcatttattagctattactcaactttacaatgcaaacatcttatttctcatctttaaacatgtcgaccagtttaattgaaaagtattctgagactgcaaaatggggtgttaaaaaatactgcagttacggagctgtgtaaaccagtttctcattgcataagatacagatgtaaattgcatggagaggttgatatgcacctgtacagtaattcactcccccatttcacatctttgtcagagaatagttcttgttcatactgagtgttctaaatttgaagttatatatacaaattaaaatattttaaaaattctgttgtcttctcatttttctggcatgtataaacatttttagcctaagtaaactgtccttttttcttatgaagactttgtcattaaatcaaaccatttatttta

SEQ ID NO: 450181 - DNA, 1333 bp, Homo sapiens
gatcagtgggcaccagctcatgagtctgtctactgccgatgccaagaaggaccccagctgcaagacctgcaacatcagcggggccttgtacgcgtacagccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccaaacctctttcagttgctggtgcagatccgtgaggaggaagccaaggaggaggaggaggaggctgaggccacccttctgcagttaggcctggaagggcacttctgagtgccaggaaaggcagctttagtgcagacctagatcacagctacttttcttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgaaattgcatgttcagatgtttactacgaggcctggctcacaggaagtgttcagtaaaagtatgcactgttagattactgataacgcggatagatttttgtttaccataaattgttccagatttatattaatggaaggaagtgtgcatttattagctattactcaactttacaatgcaaacatcttatttctcatctttaaacatgtcgaccagtttaattgaaaagtattctgagactgcaaaatggggtgttaaaaaatactgcagttacggagctgtgtaaaccagtttctcattgcataagatacagatgtaaattgcatggagaggttgatatgcacctgtacagtaattcactcccccatttcacatctttgtcagagaatagttcttgttcatactgagtgttctaaatttgaagttatatatacaaattaaaatattttaaaaattc

SEQ ID NO: 450182 - DNA, 3225 bp, Homo sapiens
cccgggaggagcagtctctccgcgcgtctcccggagctttctccattgtctctgcctttacaacagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttaccttataaaaaaaaagtctgagtatcttg

SEQ ID NO: 450183 - DNA, 3125 bp, Homo sapiens
atggaaacgggactgggtgctccgctatttaaagcttggctgctgatctcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttaccttataaaaaaaaagtctgagtatcttg

SEQ ID NO: 450184 - DNA, 2964 bp, Homo sapiens
  misc_feature (19)..(19): n is a, c, g, or t
ggctgacttagaggatccngatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttaccttataaaaaaaaagtctgagtatcttg

SEQ ID NO: 450185 - DNA, 1348 bp, Homo sapiens
agtgctgctttttcttgtctatagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttaccttataaaaaaaaagtctgagtatcttg

SEQ ID NO: 450186 - DNA, 3009 bp, Homo sapiens
cccgggaggagcagtctctccgcgcgtctcccggagctttctccattgtctctgcctttacaacaggttcgggcggcggggaagacgggggggtgcggggccgccccagcccgggctttcttggggccgccccccttctaccgggtgtgcgagtctttggctgcttttattcggctcgggagctaattccccgacggagccgcgccggggcgagtccgacccctccctccgggccccctccgggccgcgctgccgcctcggccctgcgtgtgggaatgatgtgcgcattggagggtctaagttcttcacgcgcctggggaggcctcccttttctttcttaggcaaccaaagcgtattaatcctactgatcagtaaatccgaggcagcagcaggagagacaaacgttattttcccgcttgattccaagaacctcttcgatttttatttttatttttaaagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcaggttggtataaatgaaaaactttaattaattttattcagttgtaatttgcatatgttttaagtgtgtatatggcttgatgagttttgacaatgtgtacatccacttacctaccatcacaattaatataacagaacacttccattatcccaaatgttgcctatgttctttcctagttagtcccacaaccttagatccaggcaaaaactgcatccagtccctattgattaaatttgtattttctagagcctcatataaatggagttttatagtatatactatattgtgtctgacttcattctctcaacattatgtttttgagattcaatcctattgtacctatatctctaatccatttctttttaataccgaataatatttcattgtatggatataccaatgtatttatctatccacatgttgataaaattttattactaaccatgctaattttttcctagtcacagtatcatgtttgaatgactgcataaataaagtcagaatgaacatgctgtgatccaaga

SEQ ID NO: 450187 - DNA, 1591 bp, Homo sapiens
cccgggaggagcagtctctccgcgcgtctcccggagctttctccattgtctctgcctttacaacaggttcgggcggcggggaagacgggggggtgcggggccgccccagcccgggctttcttggggccgccccccttctaccgggtgtgcgagtctttggctgcttttattcggctcgggagctaattccccgacggagccgcgccggggcgagtccgacccctccctccgggccccctccgggccgcgctgccgcctcggccctgcgtgtgggaatgatgtgcgcattggagggtctaagttcttcacgcgcctggggaggcctcccttttctttcttaggcaaccaaagcgtattaatcctactgatcagtaaatccgaggcagcagcaggagagacaaacgttattttcccgcttgattccaagaacctcttcgatttttatttttatttttaaagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatgtgagcataacttttatgatgaatactttctttggaaaaataaagcacgatcggccggaacaaacaacataaccataaatcaattcatagactaatttgtcaaccca

SEQ ID NO: 450188 - DNA, 1021 bp, Homo sapiens
  misc_feature (1020)..(1020): n is a, c, g, or t
cccgggaggagcagtctctccgcgcgtctcccggagctttctccattgtctctgcctttacaacaggttcgggcggcggggaagacgggggggtgcggggccgccccagcccgggctttcttggggccgccccccttctaccgggtgtgcgagtctttggctgcttttattcggctcgggagctaattccccgacggagccgcgccggggcgagtccgacccctccctccgggccccctccgggccgcgctgccgcctcggccctgcgtgtgggaatgatgtgcgcattggagggtctaagttcttcacgcgcctggggaggcctcccttttctttcttaggcaaccaaagcgtattaatcctactgatcagtaaatccgaggcagcagcaggagagacaaacgttattttcccgcttgattccaagaacctcttcgatttttatttttatttttaaagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataatgtttcctcaagagtcggcgnt

SEQ ID NO: 450189 - DNA, 596 bp, Homo sapiens
gccttccacagtttaaatgactaaccgagtcagtgattctgacccaccaattctagaactttaaactgcaagaacttttctttatttacccacccgtccagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatgtgagcataacttttatgatgaatactttctttggaaaaataaagcacgatcggccggaacaaacaacataaccataaatcaattcatagactaatttgtcaaccca

SEQ ID NO: 450190 - DNA, 3618 bp, Homo sapiens
cccgggaggagcagtctctccgcgcgtctcccggagctttctccattgtctctgcctttacaacaggttcgggcggcggggaagacgggggggtgcggggccgccccagcccgggctttcttggggccgccccccttctaccgggtgtgcgagtctttggctgcttttattcggctcgggagctaattccccgacggagccgcgccggggcgagtccgacccctccctccgggccccctccgggccgcgctgccgcctcggccctgcgtgtgggaatgatgtgcgcattggagggtctaagttcttcacgcgcctggggaggcctcccttttctttcttaggcaaccaaagcgtattaatcctactgatcagtaaatccgaggcagcagcaggagagacaaacgttattttcccgcttgattccaagaacctcttcgatttttatttttatttttaaagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttaccttataaaaaaaaagtctgagtatcttg

SEQ ID NO: 450191 - DNA, 1535 bp, Homo sapiens
tgatatagctgttctagaggatccctcacgccatgtccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttaccttataaaaaaaaagtctgagtatcttg

SEQ ID NO: 450192 - DNA, 1805 bp, Homo sapiens
cccgggaggagcagtctctccgcgcgtctcccggagctttctccattgtctctgcctttacaacaggttcgggcggcggggaagacgggggggtgcggggccgccccagcccgggctttcttggggccgccccccttctaccgggtgtgcgagtctttggctgcttttattcggctcgggagctaattccccgacggagccgcgccggggcgagtccgacccctccctccgggccccctccgggccgcgctgccgcctcggccctgcgtgtgggaatgatgtgcgcattggagggtctaagttcttcacgcgcctggggaggcctcccttttctttcttaggcaaccaaagcgtattaatcctactgatcagtaaatccgaggcagcagcaggagagacaaacgttattttcccgcttgattccaagaacctcttcgatttttatttttatttttaaagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatgtgagcataacttttatgatgaatactttctttggaaaaataaagcactgtattaataagtattcacccatcattggtttaatctgggcaagctaaatagctttcagaagtgatggaataaaggaagaatactttctctgttttggttgattagttcttttccattttaaaatgctatgcccctattccagtaggacaattttttcttggagtaatctattccatatagtgatagtagtaggaaacatgtgtaagaaacttactggaagttatttcactaattgtactatttattgtaagtgtctcccaaataggttaaga

SEQ ID NO: 450193 - DNA, 1352 bp, Homo sapiens
cccgggaggagcagtctctccgcgcgtctcccggagctttctccattgtctctgcctttacaacaggttcgggcggcggggaagacgggggggtgcggggccgccccagcccgggctttcttggggccgccccccttctaccgggtgtgcgagtctttggctgcttttattcggctcgggagctaattccccgacggagccgcgccggggcgagtccgacccctccctccgggccccctccgggccgcgctgccgcctcggccctgcgtgtgggaatgatgtgcgcattggagggtctaagttcttcacgcgcctggggaggcctcccttttctttcttaggcaaccaaagcgtattaatcctactgatcagtaaatccgaggcagcagcaggagagacaaacgttattttcccgcttgattccaagaacctcttcgatttttatttttatttttaaagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcaccagtagcaactagcaatgacttaccatgaactagtgcagaaaatcacaatgggaagcactgatggctaaaggagagcttgtgccacttgtcatcacccaaaatgtaaggaaacacttctgtgtgaggacggtgactgcctgagacgtaatgcagtctgacttcattccgtactccacatcca

SEQ ID NO: 450194 - DNA, 900 bp, Homo sapiens
cccgggaggagcagtctctccgcgcgtctcccggagctttctccattgtctctgcctttacaacaggttcgggcggcggggaagacgggggggtgcggggccgccccagcccgggctttcttggggccgccccccttctaccgggtgtgcgagtctttggctgcttttattcggctcgggagctaattccccgacggagccgcgccggggcgagtccgacccctccctccgggccccctccgggccgcgctgccgcctcggccctgcgtgtgggaatgatgtgcgcattggagggtctaagttcttcacgcgcctggggaggcctcccttttctttcttaggcaaccaaagcgtattaatcctactgatcagtaaatccgaggcagcagcaggagagacaaacgttattttcccgcttgattccaagaacctcttcgatttttatttttatttttaaagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaaggtatgcccggcgtgctgcatccccactgtgatttcagttccgataaccccggcaggagttgctcttgccgcttgtcctaactttgtattgcctcatggatgacagtactttagctgaggtgtagaagggccagtgtgagacacatatccctatctcttttaagtggttttttctcccctgcctcacccttctccttcgtactttgtactcttgccagttctaatgg

SEQ ID NO: 450195 - DNA, 1207 bp, Homo sapiens
cgggggcggcaccgagaagctgaaacggaagtggcgtacggcatgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggttggtgaatcctaaacagagagaattcgaggttgcctgaaagctgggtgtccttgctccttttcctggagccaatatacccagtttttactcagtttgatttatattctgggcaaggaagctttgcctactttattggcacaatccgttgttctgtcgtttagtgcatatctgctggcttcagccctggcagctgagaaattgttttctatatgtagaaggaaaacctgagcatttgcaggcatctggttaaagcagggtctgtgtgtacaattttaaaacgggtaatatgtcatgctcttagttcatcttcacaacaaaactatgagtaagcggtattagcctcacttaacagatgaggaagcaagattccagaaagtaccagaaggtcattttatacaacaggagattggttcctgcccagatgacagaaaatgggagctctgtctagttgtccttaagtctgactgacttcagtggctcataaccgtgagccaagtatttgttggttcataactgttgttttgtgaactatgtcttacatgtctagagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaaca

SEQ ID NO: 450196 - DNA, 575 bp, Homo sapiens
agaaggatgtggaaagggtgggtggagtttaaagctggcccttcctccttcagtggaagttcagcaaaatgacaaaccagataggtggctaaatttccttctcttgatgggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaaca

SEQ ID NO: 450197 - DNA, 562 bp, Homo sapiens
cgggggcggcaccgagaagctgaaacggaagtggcgtacggcatgcgccggtggcgtgatggagcggcagcagcagcagcaacagcaactgcgaaacgaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaaca

SEQ ID NO: 450198 - DNA, 2837 bp, Homo sapiens
cgggggcggcaccgagaagctgaaacggaagtggcgtacggcatgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggttggtgaatcctaaacagagagaattcgaggttgcctgaaagctgggtgtccttgctccttttcctggagccaatatacccagtttttactcagtttgatttatattctgggcaaggaagctttgcctactttattggcacaatccgttgttctgtcgtttagtgcatatctgctggcttcagccctggcagctgagaaattgttttctatatgtagaaggaaaacctgagcatttgcaggcatctggttaaagcagggtctgtgtgtacaattttaaaacgggtaatatgtcatgctcttagttcatcttcacaacaaaactatgagtaagcggtattagcctcacttaacagatgaggaagcaagattccagaaagtaccagaaggtcattttatacaacaggagattggttcctgcccagatgacagaaaatgggagctctgtctagttgtccttaagtctgactgacttcagtggctcataaccgtgagccaagtatttgttggttcataactgttgttttgtgaactatgtcttacatgtctagagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaacaaaggtctgtgtggttgtcttcacgggcaatcaggaagggagagagctggggaccatattctgcaatgcagccaaatccgaggaagagaaactgaagggagaagtagatggcaatggttatgataaaaagggataaaactaaatcttcgggacttctttaatgctacgttaatgtttcactgctcgtctagaaactcctaaatccagctttctatcatctgccccacattggtcccattgagtacattctgtgatttctaattccagcctctccattcttttctcattattgcctcccccgccccccaactttgtgtaatttacttctgtattcagcagcctggatagcatatcattccatcaccccattttcttgccaccattggccatctttttgtatcattccacttattctgtcttttccattccttcattcaaactgctagagaaaaacagttgtgtaatgaatgccactaaatattcaaggcctccaacctcagccaagtcctcacaccaacacgcagtcacaccaacacacacctttatgggttcctggtccatttccttctctaattaccatggcagttattttacacctctactgctgtccttaatcccataccccaccctcatcaggtgaccctgtttccttttttagagaaattgaagctcttagacattggtttccacagtaataattttaaaacttcttacaactacctacaaagcagatgttctatcctatctacagagcagaaaattgaaattctcaagtagcagacccggtattaaagtgcagatctgactttaaagtccatgttcattttacacagcaggctgcctcttaagatagtatttattgagcacacactttgtgtaggttctgattttggtagatgtcatgctttatattaatctttacaacaactataagtaagaggtattaacctcacttaacagatgaggaagcaagaatccagaatgtgccagaaggcacattctgcagatttcgtgcaaacatttatacacagcttcttttttttttttttgagacagagtctcgctctgtcacccaggctggagtgcagtggagcgatctaggctcactgcaacctccgccacccgggttcaagcagttctcctgcctcagcctctcgagtagctgggattacaggcatgcgccaccacgcccagctaattttgtttttgtattttaagtagagacggggtttcactatattggtcaggctggtcttgaactcctgaccttgtgatccgcccgcctcggcctccaaaagtgctgggattacaggtgtgagccaccacggccggcctatacaaagtttcttattgagaaaagtggttccaatcatgttttttgccccctttagctgctatctcttgaacagaaaagtttgttaggaaggtaaaagttgctgactaggaccttacccacagggtggcactctgtccttgggaaatataaatgcaagtaaaacaggtttgaacttcttaacttccagaagataggaggatgggacctgtgatactgtgctgctggtgggaggacccttccacatcaacatttgtgtgtatccttgcaataaacttccattgtgaattaaaaaagc

SEQ ID NO: 450199 - DNA, 2754 bp, Homo sapiens
agaaggatgtggaaagggtgggtggagtttaaagctggcccttcctccttcagtggaagttcagcaaaatgacaaaccagataggtggctaaatttccttctcttgatgggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggttggtgaatcctaaacagagagaattcgaggttgcctgaaagctgggtgtccttgctccttttcctggagccaatatacccagtttttactcagtttgatttatattctgggcaaggaagctttgcctactttattggcacaatccgttgttctgtcgtttagtgcatatctgctggcttcagccctggcagctgagaaattgttttctatatgtagaaggaaaacctgagcatttgcaggcatctggttaaagcagggtctgtgtgtacaattttaaaacgggtaatatgtcatgctcttagttcatcttcacaacaaaactatgagtaagcggtattagcctcacttaacagatgaggaagcaagattccagaaagtaccagaaggtcattttatacaacaggagattggttcctgcccagatgacagaaaatgggagctctgtctagttgtccttaagtctgactgacttcagtggctcataaccgtgagccaagtatttgttggttcataactgttgttttgtgaactatgtcttacatgtctagagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaacaaaggtctgtgtggttgtcttcacgggcaatcaggaagggagagagctggggaccatattctgcaatgcagccaaatccgaggaagagaaactgaagggagaagtagatggcaatggttatgataaaaagggataaaactaaatcttcgggacttctttaatgctacgttaatgtttcactgctcgtctagaaactcctaaatccagctttctatcatctgccccacattggtcccattgagtacattctgtgatttctaattccagcctctccattcttttctcattattgcctcccccgccccccaactttgtgtaatttacttctgtattcagcagcctggatagcatatcattccatcaccccattttcttgccaccattggccatctttttgtatcattccacttattctgtcttttccattccttcattcaaactgctagagaaaaacagttgtgtaatgaatgccactaaatattcaaggcctccaacctcagccaagtcctcacaccaacacgcagtcacaccaacacacacctttatgggttcctggtccatttccttctctaattaccatggcagttattttacacctctactgctgtccttaatcccataccccaccctcatcaggtgaccctgtttccttttttagagaaattgaagctcttagacattggtttccacagtaataattttaaaacttcttacaactacctacaaagcagatgttctatcctatctacagagcagaaaattgaaattctcaagtagcagacccggtattaaagtgcagatctgactttaaagtccatgttcattttacacagcaggctgcctcttaagatagtatttattgagcacacactttgtgtaggttctgattttggtagatgtcatgctttatattaatctttacaacaactataagtaagaggtattaacctcacttaacagatgaggaagcaagaatccagaatgtgccagaaggcacattctgcagatttcgtgcaaacatttatacacagcttcttttttttttttttgagacagagtctcgctctgtcacccaggctggagtgcagtggagcgatctaggctcactgcaacctccgccacccgggttcaagcagttctcctgcctcagcctctcgagtagctgggattacaggcatgcgccaccacgcccagctaattttgtttttgtattttaagtagagacggggtttcactatattggtcaggctggtcttgaactcctgaccttgtgatccgcccgcctcggcctccaaaagtgctgggattacaggtgtgagccaccacggccggcctatacaaagtttcttattgagaaaagtggttccaatcatgttttttgccccctttagctgctatctcttgaacagaaaagtttgttaggaaggtaaaagttgctgactaggaccttacccacagggtggcactctgtccttgggaaatataaatgcaagtaaaacaggtttgaacttcttaacttccagaagataggaggatgggacctgtgatactgtgctgctggtgggaggacccttccacatcaacatttgtgtgtatccttgcaataaacttccattgtgaattaaaaaagc

SEQ ID NO: 450200 - DNA, 1691 bp, Homo sapiens
ctacttagtttgttcagtcgtctcgatggatcagccatacaacttttgatctaaggacattctggctttattgcactgacactcacgaatggtcacagtcgttccgaccatactatctgctttgcagtctatactccgactgaccagatgtctgaagggagaagtagatggcaatggttatgataaaaagggataaaactaaatcttcgggacttctttaatgctacgttaatgtttcactgctcgtctagaaactcctaaatccagctttctatcatctgccccacattggtcccattgagtacattctgtgatttctaattccagcctctccattcttttctcattattgcctcccccgccccccaactttgtgtaatttacttctgtattcagcagcctggatagcatatcattccatcaccccattttcttgccaccattggccatctttttgtatcattccacttattctgtcttttccattccttcattcaaactgctagagaaaaacagttgtgtaatgaatgccactaaatattcaaggcctccaacctcagccaagtcctcacaccaacacgcagtcacaccaacacacacctttatgggttcctggtccatttccttctctaattaccatggcagttattttacacctctactgctgtccttaatcccataccccaccctcatcaggtgaccctgtttccttttttagagaaattgaagctcttagacattggtttccacagtaataattttaaaacttcttacaactacctacaaagcagatgttctatcctatctacagagcagaaaattgaaattctcaagtagcagacccggtattaaagtgcagatctgactttaaagtccatgttcattttacacagcaggctgcctcttaagatagtatttattgagcacacactttgtgtaggttctgattttggtagatgtcatgctttatattaatctttacaacaactataagtaagaggtattaacctcacttaacagatgaggaagcaagaatccagaatgtgccagaaggcacattctgcagatttcgtgcaaacatttatacacagcttcttttttttttttttgagacagagtctcgctctgtcacccaggctggagtgcagtggagcgatctaggctcactgcaacctccgccacccgggttcaagcagttctcctgcctcagcctctcgagtagctgggattacaggcatgcgccaccacgcccagctaattttgtttttgtattttaagtagagacggggtttcactatattggtcaggctggtcttgaactcctgaccttgtgatccgcccgcctcggcctccaaaagtgctgggattacaggtgtgagccaccacggccggcctatacaaagtttcttattgagaaaagtggttccaatcatgttttttgccccctttagctgctatctcttgaacagaaaagtttgttaggaaggtaaaagttgctgactaggaccttacccacagggtggcactctgtccttgggaaatataaatgcaagtaaaacaggtttgaacttcttaacttccagaagataggaggatgggacctgtgatactgtgctgctggtgggaggacccttccacatcaacatttgtgtgtatccttgcaataaacttccattgtgaattaaaaaagc

SEQ ID NO: 450201 - DNA, 730 bp, Homo sapiens
cgggggcggcaccgagaagctgaaacggaagtggcgtacggcatgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggttggtgaatcctaaacagagagaattcgaggttgcctgaaagctgggtgtccttgctccttttcctggagccaatatacccagtttttactcagtttgatttatattctgggcaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaaca

SEQ ID NO: 450202 - DNA, 454 bp, Homo sapiens
gagattgtttctgtttcacatatcttgaaaaacaccgactgaaaaaaatagtgtctaaactcctttgtatgacaccaagactctcctgaccttgtgatccgcccgcctcggcctccaaaagtgctgggattacaggtgtgagccaccacggccggcctatacaaagtttcttattgagaaaagtggttccaatcatgttttttgccccctttagctgctatctcttgaacagaaaagtttgttaggaaggtaaaagttgctgactaggaccttacccacagggtggcactctgtccttgggaaatataaatgcaagtaaaacaggtttgaacttcttaacttccagaagataggaggatgggacctgtgatactgtgctgctggtgggaggacccttccacatcaacatttgtgtgtatccttgcaataaacttccattgtgaattaaaaaagc

SEQ ID NO: 450203 - DNA, 588 bp, Homo sapiens
cagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaaca

SEQ ID NO: 450204 - DNA, 1145 bp, Homo sapiens
cgggggcggcaccgagaagctgaaacggaagtggcgtacggcatgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggtcctggagccaatatacccagtttttactcagtttgatttatattctgggcaaggaagctttgcctactttattggcacaatccgttgttctgtcgtttagtgcatatctgctggcttcagccctggcagctgagaaattgttttctatatgtagaaggaaaacctgagcatttgcaggcatctggttaaagcagggtctgtgtgtacaattttaaaacgggtaatatgtcatgctcttagttcatcttcacaacaaaactatgagtaagcggtattagcctcacttaacagatgaggaagcaagattccagaaagtaccagaaggtcattttatacaacaggagattggttcctgcccagatgacagaaaatgggagctctgtctagttgtccttaagtctgactgacttcagtggctcataaccgtgagccaagtatttgttggttcataactgttgttttgtgaactatgtcttacatgtctagagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaaca

SEQ ID NO: 450205 - DNA, 658 bp, Homo sapiens
cgggggcggcaccgagaagctgaaacggaagtggcgtacggcatgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaaca

SEQ ID NO: 450206 - DNA, 1923 bp, Homo sapiens
aacgcccttgtcgcgagacattatacgcgaggcgtgaactcattggtcaacccaaatgacaactcgccaactgattggctactctcacttcacctttgctccgcccctttccctggcactctcttccgcctccttcctgcctccctgtcgcgtgcgcgtgaccaggagcctagcacctccctttcctctgcttccgccacttccgccctggagaacatttctcacccaggattggtagaaacctaagagcgcatgcgcactgagaggataccgctaaaaatcgccttcaaaattgcttaaaaggcaaactttaacaatgcgatctaagagtcgtagtgactggccaaaaaaaaccgcaattttggggtctaattcgattgtgacgcagttgaaattagcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattcgtcggaataaagttgttgggaatccctgccccatctgtcgagatcacaagttgcatgttgactttaggaacgtgaagctcttggagcaatttgtctgcgcccacacgggtatcatcttctatgctccatacacaggagtctgtgtgaagcagcacaagcggttgacccaggccatccagaaagccagggatcatggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctgg

SEQ ID NO: 450207 - DNA, 518 bp, Homo sapiens
atgaatgtgctgttatgccttaaatgtgtgcaccaggaaatgcaaactagaaagggtggctctgaagggtcctcaggtgaggaagacccccagggctgagaatccaccaccttcatccttcaaaagagtacctcagttgtctgcttacgcttcagccagcatgtgtgagcttggtcatttcctgcaagccaggcaaccacaccagtgtataagcctcaagcaaatgtcactcccaagccccaaatgggactaaggcctctgctgggctaggcgtggtgtaaatcccaggcctggaagctcctacccaaccctcatttgtttcaactcactttcaatatgtgcatagtttcataaagcagacatttccatgaggaaaagaggatggtggtgaaaggggagatgtgtatgggaaaccccaacccctatatattgtaaatagatgggctgggctaaacattgttgccgtttcatacttctaccaactcagcttttacacaataaagctctactgtctctgg

SEQ ID NO: 450208 - DNA, 1873 bp, Homo sapiens
aacgcccttgtcgcgagacattatacgcgaggcgtgaactcattggtcaacccaaatgacaactcgccaactgattggctactctcacttcacctttgctccgcccctttccctggcactctcttccgcctccttcctgcctccctgtcgcgtgcgcgtgaccaggagcctagcacctccctttcctctgcttccgccacttccgccctggagaacatttctcacccaggattggtagaaacctaagagcgcatgcgcactgagaggataccgctaaaaatcgccttcaaaattgcttaaaaggcaaactttaacaatgcgatctaagagtcgtagtgactggccaaaaaaaaccgcaattttggggtctaattcgattgtgacgcagttgaaattagcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattcgtcggaataaagttgttgggaatccctgccccatctgtcgagatcacaagttgcatgttgactttaggaacgtgaagctcttggagcaatttgtctgcgcccacacgggtatcatcttctatgctccatacacaggagtctgtgtgaagcagcacaagcggttgacccaggccatccagaaagccagggatcatggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctgg

SEQ ID NO: 450209 - DNA, 1856 bp, Homo sapiens
aacgcccttgtcgcgagacattatacgcgaggcgtgaactcattggtcaacccaaatgacaactcgccaactgattggctactctcacttcacctttgctccgcccctttccctggcactctcttccgcctccttcctgcctccctgtcgcgtgcgcgtgaccaggagcctagcacctccctttcctctgcttccgccacttccgccctggagaacatttctcacccaggattggtagaaacctaagagcgcatgcgcactgagaggataccgctaaaaatcgccttcaaaattgcttaaaaggcaaactttaacaatgcgatctaagagtcgtagtgactggccaaaaaaaaccgcaattttggggtctaattcgattgtgacgcagttgaaattagcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattcgtcggaataaagttgttgggaatccctgccccatctgtcgagatcacaagttgcatgttgactttagggagtctgtgtgaagcagcacaagcggttgacccaggccatccagaaagccagggatcatggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctgg

SEQ ID NO: 450210 - DNA, 1041 bp, Homo sapiens
  misc_feature (143)..(143): n is a, c, g, or t
  misc_feature (146)..(146): n is a, c, g, or t
ttcctagatcatctgtcggtcatatgggtagagtatcccataatagtactagcatttgacctagttcgagggctaaatgtactccagttatcaaagtcatcatcgctgtgagagccaggtcttgcaggccatccagaaagccnggnatcatggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctgg

SEQ ID NO: 450211 - DNA, 719 bp, Homo sapiens
  misc_feature (101)..(101): n is a, c, g, or t
gatcgagctgctgtgacacccttgggatctgggcttaacctcctgggctttacgagggccttgatagcctcggcacgtgcactcatggcttggattgtggnctgcatcttctttaggccctttttgttgtgcttcttggcaaagcgcatgttcctcaggaacttggggtccacccccttaagagattcgtattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattgaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctgg

SEQ ID NO: 450212 - DNA, 1159 bp, Homo sapiens
aacgcccttgtcgcgagacattatacgcgaggcgtgaactcattggtcaacccaaatgacaactcgccaactgattggctactctcacttcacctttgctccgcccctttccctggcactctcttccgcctccttcctgcctccctgtcgcgtgcgcgtgaccaggagcctagcacctccctttcctctgcttccgccacttccgccctggagaacatttctcacccaggattggtagaaacctaagagcgcatgcgcactgagaggataccgctaaaaatcgccttcaaaattgcttaaaaggcaaactttaacaatgcgatctaagagtcgtagtgactggccaaaaaaaaccgcaattttggggtctaattcgattgtgacgcagttgaaattagcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattcgtcggaataaagttgttgggaatccctgccccatctgtcgagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctgg

SEQ ID NO: 450213 - DNA, 298 bp, Homo sapiens
aataaagttgttgggaatccctgccccatctgtcgagatcacaagttgcatgttgactttagggtaaggagagtcttttctttttagggtaagaaaaataaagattaggggctgggcgcggtggctcacgcctgtaatcccagcactttgggaggccaaggcaggtggatcatgaggtcaggagatcaagaccatcctggctaacacggtgaaaccccgtctctactaaaaatacaaaaaattagccggttgtggtggcgggcgcctgtagtcccagctactcaggaggctgaggcag

SEQ ID NO: 450214 - DNA, 2144 bp, Homo sapiens
aacgcccttgtcgcgagacattatacgcgaggcgtgaactcattggtcaacccaaatgacaactcgccaactgattggctactctcacttcacctttgctccgcccctttccctggcactctcttccgcctccttcctgcctccctgtcgcgtgcgcgtgaccaggagcctagcacctccctttcctctgcttccgccacttccgccctggagaacatttctcacccaggattggtagaaacctaagagcgcatgcgcactgagaggataccgctaaaaatcgccttcaaaattgcttaaaaggcaaactttaacaatgcgatctaagagtcgtagtgactggccaaaaaaaaccgcaattttggggtctaattcgattgtgacgcagttgaaattagcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaaggtacctctaaagggggaaagggagggtcagataggatttgagataagtggacagagccacccactacactcccacccaggaataacttgtatgatctttcatttcagaataccaggagcgatatggttctcgccccgtctgggctgactaccgccgcaaccacaagggtggtgtacccccacagcggactcggaagacatgtattgtgagtttctgagagtgggatgtggagtgcggggaggccacaagtaacagtaacagcagcactttttctgacgtgtttgaacatccttaactgctgttttttttctctctacagcgtcggaataaagttgttgggaatccctgccccatctgtcgagatcacaagttgcatgttgactttaggaacgtgaagctcttggagcaatttgtctgcgcccacacgggtatcatcttctatgctccatacacaggagtctgtgtgaagcagcacaagcggttgacccaggccatccagaaagccagggatcatggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctgg

SEQ ID NO: 450215 - DNA, 973 bp, Homo sapiens
aacaagatatttttctccccacaggagtctgtgtgaagcagcacaagcggttgacccaggccatccagaaagccagggatcatggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctgg

SEQ ID NO: 450216 - DNA, 1203 bp, Homo sapiens
aacgcccttgtcgcgagacattatacgcgaggcgtgaactcattggtcaacccaaatgacaactcgccaactgattggctactctcacttcacctttgctccgcccctttccctggcactctcttccgcctccttcctgcctccctgtcgcgtgcgcgtgaccaggagcctagcacctccctttcctctgcttccgccacttccgccctggagaacatttctcacccaggattggtagaaacctaagagcgcatgcgcactgagaggataccgctaaaaatcgccttcaaaattgcttaaaaggcaaactttaacaatgcgatctaagagtcgtagtgactggccaaaaaaaaccgcaattttggggtctaattcgattgtgacgcagttgaaattagcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattgaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctgg

SEQ ID NO: 450217 - DNA, 1885 bp, Homo sapiens
agctacgagcgcggagcttgcgcagaagacccccatcagggtgcggggtgcagttgcggctccagggccatggcggaggagcagggccgggaacgggactcggttcccaagccgtcggtgctgttcctccacccagacctgggcgtgggcggcgctgagcggctggtgttggacgcggcgctggcgctgcaggcgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggttttcctggcgctctacgtgctgttcctcgccgacgaggagttcgacgtggtagtgtgcgaccaggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcata

SEQ ID NO: 450218 - DNA, 2851 bp, Homo sapiens
  misc_feature (1286)..(1286): n is a, c, g, or t
ttttttaaaatatttttgtacttctgcaaatatgtcgtttgaggaaattcctaaagttggtgggtctaagagttgttcattttaaatatcaatagctactgccaagtttgcctaccaaggaggctgtgtcactttactcccccacaatgtatgatagagcctcttactccatgcttttgtccgccttggatattaaccattttaaactttgccaaactgataggtgcagatggcatcacatttgtatttgtgtttctttaattatgactcctgagttacttttgatcatccttgcttgcatggaagctttctttttaagtaacgtggacatttaccaaacatcctgcatgtgtcagtagacatgaggcagctgagactatagtgggtagaggaaaaattattggcttggaaataggcatcttggattcaagttccgtatctactgctttaattaagtggctttgaataaattgcacattatccctaaagttaccttcttcaggttttaagttagctgagactaaaatgacttgtaaagattacccaacaagaaagtctgtagtaatgccagcatgtagttcatgctcaatgatgactagctttaatatttattgagcacatactgtgtgctaaactccatgtgttttgcatatatcagtgcatttaataatcacaaaaagtatatgggttttttgaactataatttgtcaccatgttacagaagaggaaactaaggcccagagtgggataaattacttgatcgtggccagttagtagagctgagattcaaaccctggcagtcttgaatctagagcttgtgctctaaactactatagttcattcattcagttccttagaaggagaaagatcctagagcggcactgttcagtatggtagccactagccacatgtggctgttgagcacttgaaatgtggctagtctaaactgagatgtgctaaagttaaaatacaaaccgattttgaagatgtaatgtgaaatatatgtatatataaagtatctcattaatactgtttagtattggttacattttgaaatgataatgttttcggtaaataatatgttaaaattaatttcacccttaaaaacatttttaatattactagatttctattagacagcactatacaagaggaaatcactggacttgaagctttaaatgtttagcacacatctagcaaacgtctgtagccttctgtacaccaggcatatggtactgggtgagagtcttggggaataaaacagaatcagacattgcccatgaggngcccacagactagccagacggggtgggtgtctgtgtttttggtttggttgaagttgagttgaccactttatccgctgttgatttttgctttggctaggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcata

SEQ ID NO: 450219 - DNA, 2787 bp, Homo sapiens
agctacgagcgcggagcttgcgcagaagacccccatcagggtgcggggtgcagttgcggctccagggccatggcggaggagcagggccgggaacgggactcggttcccaagccgtcggtgctgttcctccacccagacctgggcgtgggcggcgctgagcggctggtgttggacgcggcgctggcgctgcaggcgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggttttcctggcgctctacgtgctgttcctcgccgacgaggagttcgacgtggtagtgtgcgaccaggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcataaaaaagaaacagtattagattttggtctccataatctattttggtattgttacgaacatggatatgacaaccaaactggaaatcagaacactagggtaaagtggatattgaaatgaagcaagaatattgtcacacatgtgttgtgcatcttgtttagggtatatttcttaatgtcatctaggtcattagttttgttaatatttgtgttgtcttgaccaagctcctactaagtataggacacaaatgttttttatcttccaaggcctggctcaaatgccactgctgcaaagcttttctttgaccctctggccacctcccaagccagaagttatcttccccctccatgtactctagcccttttcatgacactggatattttcgtggacactgacttatagttcactgtttacctgttggtctaacagcaaatcataaacagtagttttcaacatactttctaaggctaaattcatttccagaagtagcaaagcttactagccaaaggctccacatttatcaactcttaagagctagacttgagagcctaacagcctatatgattttgtgtaaattgatctctatacctcagcttcttcatctgcaaagtgagataattgtactattctactttcctcatagtgcggttataacagattatgataatattacaaagtacttaatacttggcatatagtatatatattagctattagtattttgcaatttggggatattgaaaattagaaattgcatgttagttcatgctgcactaccatattgttcttttggggctcttcaatgggtgaaattccattttacagtttatcatgtgcatctgtatcacaggagtattttggcaaaatgattctgtaccaaaaaggagtactataaaatgagggtgccaaatatattgagtcttttatgggattaaaagttctgttgcattccaaaaactt

SEQ ID NO: 450220 - DNA, 2044 bp, Homo sapiens
agctacgagcgcggagcttgcgcagaagacccccatcagggtgcggggtgcagttgcggctccagggccatggcggaggagcagggccgggaacgggactcggttcccaagccgtcggtgctgttcctccacccagacctgggcgtgggcggcgctgagcggctggtgttggacgcggcgctggcgctgcaggcgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggttttcctggcgctctacgtgctgttcctcgccgacgaggagttcgacgtggtagtgtgcgaccaggccatttgcatcccactgtccttgtgttcggagccaggccacaccgtcctcagcagtgtcatgtgttaaaaacgccaagctgaatatatcatgcccctattaaaacttgtacatggctccccattggtttttggagaaaagttcaagctttttaccttggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcata

SEQ ID NO: 450221 - DNA, 2007 bp, Homo sapiens
agctacgagcgcggagcttgcgcagaagacccccatcagggtgcggggtgcagttgcggctccagggccatggcggaggagcagggccgggaacgggactcggttcccaagccgtcggtgctgttcctccacccagacctgggcgtgggcggcgctgagcggctggtgttggacgcggcgctggcgctgcaggcgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggttttcctggcgctctacgtgctgttcctcgccgacgaggagttcgacgtggtagtgtgcgaccaggccacaccgtcctcagcagtgtcatgtgttaaaaacgccaagctgaatatatcatgcccctattaaaacttgtacatggctccccattggtttttggagaaaagttcaagctttttaccttggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcata

SEQ ID NO: 450222 - DNA, 1594 bp, Homo sapiens
ccttctacgtccttctacgtctcatcactgccttctacgtccttctacgtctcatcactgccttctacgtccttctacgtctcatcactgccttctacgtctcatcactgatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcataaaaaagaaacagtattagattttggtctccataatctattttggtattgttacgaacatggatatgacaaccaaactggaaatcagaacactagggtaaagtggatattgaaatgaagcaagaatattgtcacacatgtgttgtgcatcttgtttagggtatatttcttaatgtcatctaggtcattagttttgttaatatttgtgttgtcttgaccaagctcctactaagtataggacacaaatgttttttatcttccaaggcctggctcaaatgccactgctgcaaagcttttctttgaccctctggccacctcccaagccagaagttatcttccccctccatgtactctagcccttttcatgacactggatattttcgtggacactgacttatagttcactgtttacctgttggtctaacagcaaatcataaacagtagttttcaacatactttctaaggctaaattcatttccagaagtagcaaagcttactagccaaaggctccacatttatcaactcttaagagctagacttgagagcctaacagcctatatgattttgtgtaaattgatctctatacctcagcttcttcatctgcaaagtgagataattgtactattctactttcctcatagtgcggttataacagattatgataatattacaaagtacttaatacttggcatatagtatatatattagctattagtattttgcaatttggggatattgaaaattagaaattgcatgttagttcatgctgcactaccatattgttcttttggggctcttcaatgggtgaaattccattttacagtttatcatgtgcatctgtatcacaggagtattttggcaaaatgattctgtaccaaaaaggagtactataaaatgagggtgccaaatatattgagtcttttatgggattaaaagttctgttgcattccaaaaactt

SEQ ID NO: 450223 - DNA, 2841 bp, Homo sapiens
agctacgagcgcggagcttgcgcagaagacccccatcagggtgcggggtgcagttgcggctccagggccatggcggaggagcagggccgggaacgggactcggttcccaagccgtcggtgctgttcctccacccagacctgggcgtgggcggcgctgagcggctggtgttggacgcggcgctggcgctgcaggcgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggttttcctggcgctctacgtgctgttcctcgccgacgaggagttcgacgtggtagtgtgcgaccaggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcataaaaaagaaacagtattagattttggtctccataatctattttggtattgttacgaacatggatatgacaaccaaactggaaatcagaacactagggtaaagtggatattgaaatgaagcaagaatattgtcacacatgtgttgtgcatcttgtttagggtatatttcttaatgtcatctaggtcattagttttgttaatatttgtgttgtcttgaccaagctcctactaagtataggacacaaatgttttttatcttccaaggcctggctcaaatgccactgctgcaaagcttttctttgaccctctggccacctcccaagccagaagttatcttccccctccatgtactctagcccttttcatgacactggatattttcgtggacactgacttatagttcactgtttacctgttggtctaacagcaaatcataaacagtagttttcaacatactttctaaggctaaattcatttccagaagtagcaaagcttactagccaaaggctccacatttatcaactcttaagagctagacttgagagcctaacagcctatatgattttgtgtaaattgatctctatacctcagcttcttcatctgcaaagtgagataattgtactattctactttcctcatagtgcggttataacagattatgataatattacaaagtacttaatacttggcatatagtatatatattagctattagtattttgcaatttggggatattgaaaattagaaattgcatgttagttcatgctgcactaccatattgttcttttggggctcttcaatgggtgaaattccattttacagtttatcatgtgcatctgtatcacaggagtattttggcaaaatgattctgtaccaaaaaggagtactataaaatgagggtgccaaatatattgagtcttttatgggattaaaagttctgttgcattccaaaaactt

SEQ ID NO: 450224 - DNA, 2453 bp, Homo sapiens
agctacgagcgcggagcttgcgcagaagacccccatcagggtgcggggtgcagttgcggctccagggccatggcggaggagcagggccgggaacgggactcggttcccaagccgtcggtgctgttcctccacccagacctgggcgtgggcggcgctgagcggctggtgttggacgcggcgctggcgctgcaggcgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggttttcctggcgctctacgtgctgttcctcgccgacgaggagttcgacgtggtagtgtgcgaccaggtgaggcggccgcggggccggctgcgcgagtgcggacctcgccgtggagggcggccgcgggcatgacccctgagagaagaccttccctgtctgcggttcgcaaagatcggaactgacatggagaagtcagggttgtgagcgagcctgtggttctctaactttagtgtgggcccatttaaagttgcagattgctggggttccatcctccaggaagttttcatccaggtgccctgaggtggggcccagacatctgcattttaactgggtcatagggtgattccgaggtagatagtctttggggctctgagaaacgctggtattagaagtcagcttcagtcaccttttactaatgagtaactcgcgtgttgtcttcccgcttacctgttatttttgttgactctcctttcaggccatttgcatcccactgtccttgtgttcggagccaggccacaccgtcctcagcagtgtcatgtgttaaaaacgccaagctgaatatatcatgcccctattaaaacttgtacatggctccccattggtttttggagaaaagttcaagctttttaccttggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcata

SEQ ID NO: 450225 - DNA, 2279 bp, Homo sapiens
agctacgagcgcggagcttgcgcagaagacccccatcagggtgcggggtgcagttgcggctccagggccatggcggaggagcagggccgggaacgggactcggttcccaagccgtcggtgctgttcctccacccagacctgggcgtgggcggcgctgagcggctggtgttggacgcggcgctggcgctgcaggcgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggttttcctggcgctctacgtgctgttcctcgccgacgaggagttcgacgtggtagtgtgcgaccaggtgaggcggccgcggggccggctgcgcgagtgcggacctcgccgtggagggcggccgcgggcatgacccctgagagaagaccttccctgtctgcggttcgcaaagatcggaactgacatggagaagtcagggttgtgagcgagcctgtggttctctaactttagtgtgggcccatttaaagttgcagattgctggggttccatcctccaggaagttttcatccaggtgccctgaggccatttgcatcccactgtccttgtgttcggagccaggccacaccgtcctcagcagtgtcatgtgttaaaaacgccaagctgaatatatcatgcccctattaaaacttgtacatggctccccattggtttttggagaaaagttcaagctttttaccttggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcata

SEQ ID NO: 450226 - DNA, 3192 bp, Homo sapiens
  misc_feature (3)..(3): n is a, c, g, or t
  misc_feature (6)..(7): n is a, c, g, or t
ggnacnngcggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaagatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagtttgtgtattcattaaaagaaaactaactggaaaacaggttagattaattcagtactattaaaaaagaattcagagctgttaatattttatca

SEQ ID NO: 450227 - DNA, 3330 bp, Homo sapiens
  misc_feature (3)..(3): n is a, c, g, or t
  misc_feature (6)..(7): n is a, c, g, or t
ggnacnngcggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaagatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagttgcgctgaaatagcagatgaagtttacatggaagtcattgtaggggaagaggaaggaacttctctccctgagattcagcttgaggactctgatgttaataaaacagttgtccctgttgtctgggctgcggcatatggagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagtttgtgtattcattaaaagaaaactaactggaaaacaggttagattaattcagtactattaaaaaagaattcagagctgttaatattttatca

SEQ ID NO: 450228 - DNA, 392 bp, Homo sapiens
cttggcactttgaaatttattttggaatttattttttttctaagaaatatttctatatattcttcttattaatttaggtggttattccatgatacttctctattttaatgcgtgttttaatttttaaggtggaacagaaattgtcacagagagtgagtacaccagtggacattcagtagctggagtgcttgaccagagccgaatgcagcgggagaagatggtttacatggcagttaaagattcttctcaagaagaagatgatatcagtaagaaaataagggcactgtagtgacttatcagtagccatcatgcattatttttaaaaaatctcagagatacaagcactgtataggaacaaagttcaataaaataagcctgatcctttgaccctt

SEQ ID NO: 450229 - DNA, 601 bp, Homo sapiens
gatattgcattttggcatgtgagtggttcatagtagagtgctgctcattactttttagtgagctactttgccataaattgcttttattatgtattttttatattacaggatttcattcaactagtattgttttcacatagtgaatgccaactagttttggcacctttgttataaaatcctttaaaacagtctgaccaaatgtcacaactttctcttttctttatctagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggca

SEQ ID NO: 450230 - DNA, 648 bp, Homo sapiens
cgtgtcacctttctgaaactttcattaaggttgcagctttatctgttgtgcaatatggtacaatttattaagcagtcctacgtgaaaaggagataagtgccttataaaattgacaggtttttgttgatttacttagaatcttatgtttgaagagaaaatgcacatatatgtgtctaagaaatacattgagtgacagcatctgactttatgttccatactatcaaatggtcgtaaatataggataagtcatttgaaatgaaatagattgagcccttgctttcaaaaccaccttgaagctagcataattttattaatcactaataaaaagtcagttgtacaattacaagtaaatgaaatgctgagataaataatttgctaaatgtttgtatgtgatcgatcttatttttaccatatttaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcact

SEQ ID NO: 450231 - DNA, 3958 bp, Homo sapiens
tctcaattatgaaatcttgcagagaagttatttttctttctcaaaatccaggtgatgacaatattccttactccagatctggcattttttcatcatcactgtcttgtgaatcatcatctgctccatctacttctggtaaatctacatcctcatcaccacccatgttgttcatcatctcagagaaacgatcaaaattagacatgtcttcatctgaatcatcttcccagtctttccaattattgaagtcgacactaagccaattaagctttgccctttcttttgttaccttggccatgactggaagattctccttttcgtaaacaacataaaattgatctgtccgttcttttatgcttggaatcatttggatcaatacagtgaaaaagatcaatttcatttaaatgcttaaaattatcatcttcctccgagacaactgaatgtaagttttggatttttcaaaatttacattaactccttactgtcttcaacacaaaattcaatgaagacattagtcccttcgatcgtaccactttgcagaagcaggctgcattgtgaacggggcaggggacggggccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcactaatactagacatctgagtcctctaatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagtttgtgtattcattaaaagaaaactaactggaaaacaggttagattaattcagtactattaaaaaagaattcagagctgttaatattttatca

SEQ ID NO: 450232 - DNA, 4048 bp, Homo sapiens
tctcaattatgaaatcttgcagagaagttatttttctttctcaaaatccaggtgatgacaatattccttactccagatctggcattttttcatcatcactgtcttgtgaatcatcatctgctccatctacttctggtaaatctacatcctcatcaccacccatgttgttcatcatctcagagaaacgatcaaaattagacatgtcttcatctgaatcatcttcccagtctttccaattattgaagtcgacactaagccaattaagctttgccctttcttttgttaccttggccatgactggaagattctccttttcgtaaacaacataaaattgatctgtccgttcttttatgcttggaatcatttggatcaatacagtgaaaaagatcaatttcatttaaatgcttaaaattatcatcttcctccgagacaactgaatgtaagttttggatttttcaaaatttacattaactccttactgtcttcaacacaaaattcaatgaagacattagtcccttcgatcgtaccactttgcagaagcaggctgcattgtgaacggggcaggggacggggccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcactaatactagacatctgagtcctctaatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagttgcgctgaaatagcagatgaagtttacatggaagtcattgtaggggaagaggaaggaacttctctccctgagattcagcttgaggactctgatgttaataaaacagttgtccctgttgtctgggctgcggcatatggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagtttgtgtattcattaaaagaaaactaactggaaaacaggttagattaattcagtactattaaaaaagaattcagagctgttaatattttatca

SEQ ID NO: 450233 - DNA, 421 bp, Homo sapiens
tgcgtctgtcaactgcggtttcgcttgcgtctttcaactgcggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtaagagggagcagagagcccagaggtggggtgagtgtgaggaaggcagtagaggtctggggaccccaatgctatagcacctccctgaaggaaccactactggggataatctcatgtcctagctccacgctaa

SEQ ID NO: 450234 - DNA, 191 bp, Homo sapiens
cgcctgcaatccatttgaaactaggctgtggaaaaggagcaaaaatcgtccaatgctgctttcacttttgcttccaaatccagctccctgtgtttgttcccatggtcaggggtgggaaattaggttcagagtgagggtgaggaagaggagtttctgtgggggccagggatgtttcaagagagatagtcaac

SEQ ID NO: 450235 - DNA, 3098 bp, Homo sapiens
  misc_feature (76)..(76): n is a, c, g, or t
  misc_feature (756)..(756): n is a, c, g, or t
cttttcctgaattatgtctgtttccctctggtcagccattggagggaggagaggggctgtggatttcttgaaggcntcccactcacctgagggctggggtctaggaggttgtgaaggcagcattgggagccatgcccccatccccacagtgcggggctagcaggagaggaggaggtagatctcattgtacacatccgtcttctggagagaacaacctctcctaccatcccttccttctacaccttctctgcctgtcataggtggctgcaggaggggtccacgttgggagggacaggtgagctggcctttggtgctgacacactcctgactttgccctttctcctgcagggggtgccattcccgcagaatgaggctaatgccatggatgtggtggtccagtttgccatccaccgccctgggcttccagccccaggacatcatcatctacgcctggtccatcggcggcttcactggtaccagcctccctcccatcccccactgtagacacattcatgaccacccagccccacccgggagaggtggggaaatggggtggggtggaggctcaaggaagaagagagaggaagtagaatctctgagtgggcctggaagaagctatcctatttgcatacacttcacctttccttcccctcttgtgcccagtcattaaaaggaaaagcagacccaggtcctgggtggggagatcagggaaagtgaatgtttcctgcccattatcttcagtgcactatctccagngttctatccccatcctctccagatagttccctaaccaagtgaagtaggttaagaaaaaaacaagggataacatagggggaatggggttggcctatagggtcagtgggatgagagcatgggtggtggggagaaaggagcctttctcagttcttactcttcttccctgccctggtaccagccacgtgggcagccatgtcctacccagatgttagtgccatgatcctggatgcctcctttgatgacctggtgcccttggccttgaaggtcatgccagacagctggagtgagtgcagctcccaggcctgcccttcctgggaaggggtgggctggaactgggaactgttctgagatggctcccttttcttgggtggggagtaagtcgccccattgttggaagcaggaggactcctttgtctgggggcctcagttttctttctccgtgaatagtgaggacctttatgttgggcaagggctttgtctctgccatcccttcacctttatcccactctagggggcctggtgaccaggaccgtgaggcagcatctcaatctaaacaacgcggagcagctgtgcaggtgagggccggccagcgtccggcattgaacacctgccccccatacagctctgctgggcgctcaaaccctgaaactagtactaaagtgcaagttggtaaaaggccactggctcacatcctgagtgaccctgccaccacctcaactggcctaacccctcccaggtcccctgggactctggaccacctcaggatctggcaaccaaagggttaaggcctggcacggcaggggtctcccagcagggccagactgaaccatgccccttaaataatcccctctcacccctgagtgaagggctaggtcaagggctgtgctatagcaaggggagggtaagaatgctaccagtgcagggataggggtgggccagttgtcacccgtctccctctgagctctcccttcccactgctctgttctctgaagataccagggtcctgtactgctgatccggagaaccaaggatgagatcatcaccaccacgtgagtgcgtgggaatctcggccctcaggaaccccagagatggccaggaacttgtcccttctacctctgcccaccagaaacctgggtatctagacccttcctcctaacctccagcccctccagggtacattcttctcacccccagggttcctgaggacatcatgtccaaccgaggcaatgacctcctgctgaagctcctgcagcatcggtgagagccagggtgtgtgcgcgctgggggcagtgtacacacacagatactgataccagcacagggaaggagggaggaaggttcagggatggtgaatgaaaaaaaatcagccctgacctgtcctggcacttcctccgtaggtatccccgggtgatggcagaggagggtcttcgagtggtgaggcagtggttggaggcctcctcacagctggaggaaggtgagaagggatccagtgaggcttggggcgggggcccagcaaggtcaggttgctgactggctgtcatctctctccctgaccagcctcaatttatagccgatgggaggtggaagaggactggtgtctgtctgtcctccgctcctaccaggcagaacacgggcccgacttcccctggagcgtgggtaaggagctcctggggcaggagagagggtgggaagggcctaggaaggggatgaatacccagatgtgtggcctattttgagcgcctcctctctgcaggggaggacatgagtgcagatggacggcggcagctggctttgtttctggtgagctaaggagtgggaagtgggaagggttcttgaatggccagggctcacatagggggactggggataccctataagcattggaagtggcagcttttgtagagtgggtggtggatgcggaagtggagggtggggagggagtccagtggctgcccctcccaacagtgctctgtaccccacctgtcccacctcctttcctcaggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450236 - DNA, 2480 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaaggtaggacggtgactcagcctccttatctccgccctttgaaagggaatgtccctgcctcccacactgacctgacctcccctggcctctgctttctctgggtgaggttttgagtctctcagctttagggaaaagtccactcgccatttgctttgataaccttacatccctcccctggcctgtgtccctagctattatgcttttcattctgttccattcccccaccacacaccccacacaatcacatgctgctccctgtgctgcctcagaacctctggtgtcatctcctatttctgggaaggcttggagttatttgcatctaagctggggggtacttctgctcttccttcccccagggatggagaaagggctgtgggccacaaggtctcagtccttcctccccctgtgttacagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450237 - DNA, 2297 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggagtgagtgcagctcccaggcctgcccttcctgggaaggggtgggctggaactgggaactgttctgagatggctcccttttcttgggtggggagtaagtcgccccattgttggaagcaggaggactcctttgtctgggggcctcagttttctttctccgtgaatagtgaggacctttatgttgggcaagggctttgtctctgccatcccttcacctttatcccactctagggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450238 - DNA, 2214 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacgtgagtgcgtgggaatctcggccctcaggaaccccagagatggccaggaacttgtcccttctacctctgcccaccagaaacctgggtatctagacccttcctcctaacctccagcccctccagggtacattcttctcacccccagggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450239 - DNA, 2354 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacgtgagtgcgtgggaatctcggccctcaggaaccccagagatggccaggaacttgtcccttctacctctgcccaccagaaacctgggtatctagacccttcctcctaacctccagcccctccagggtacattcttctcacccccagggttcctgaggacatcatgtccaaccgaggcaatgacctcctgctgaagctcctgcagcatcggtgagagccagggtgtgtgcgcgctgggggcagtgtacacacacagatactgataccagcacagggaaggagggaggaaggttcagggatggtgaatgaaaaaaaatcagccctgacctgtcctggcacttcctccgtaggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450240 - DNA, 2167 bp, Homo sapiens
ccgcctcctttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450241 - DNA, 2002 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450242 - DNA, 2661 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatcaaaaaaaaaaaaaaaaaaaaaaaaaaaaaaaaaaaaaaaaaaaaaaaaaaaaacgaaacaaaaaaaaaaaaaaaaaaaaaagagagggccgcgagacgcgacaaagaataatatcctgggggaggaagcacggaaaatagatgagagcccacctgcattgttgtagaacagagcgggcgcccacattgagaaggaggttatcataagcagcgcgcgcgcgcccggttacaacaccgcggcggagtgaaaacactaaccgccattacgagcagttcacttcttggcgaaggcacccccccccatcttctgtgggggggcgaccaacaaattatgaggcgagcccacccaatacacgaaggtatatttataacctccccatgggcaggaatatacatactactaagacagcatatcactagtgtcaacacccaccaacccatattatttgtccgccaccaacaaaaaaattattcgccacacacagcttcatataatcagccgcaaacataatttcacccaccgacgacgaaaaaaaacacagaacgtcatcatagatcccaacaacacacacactcgatctcgcttctgtggc

SEQ ID NO: 450243 - DNA, 2280 bp, Homo sapiens
  misc_feature (1250)..(1250): n is a, c, g, or t
aagataacagacccgaaaacgagaaaggaaaaacatctccatagtccccttcctgaaagagatccagctggtaatcttccaaggaaaagacatggctgggtggtcgagcaggtcagcctctgaggagtatttgtaatccctttgcttctcctcttatggaccctgtggaatgagaagcttccattccccttggagaaaacagaaacctgccctttcctcttccctgcaaagctcttcatgggctgccctccctgcccaaagggagtttttcagtcccaacttggccccccagcccttccttcctgcctccttcctaggtgatctgctgtgaggggaatgctgggttttatgaggtgggctgcgtctccacgcccctggaaggtaggacggtgactcagcctccttatctccgccctttgaaagggaatgtccctgcctcccacactgacctgacctcccctggcctctgctttctctgggtgaggttttgagtctctcagctttagggaaaagtccactcgccatttgctttgataaccttacatccctcccctggcctgtgtccctagctattatgcttttcattctgttccattcccccaccacacaccccacacaatcacatgctgctccctgtgctgcctcagaacctctggtgtcatctcctatttctgggaaggcttggagttatttgcatctaagctggggggtacttctgctcttccttcccccagggatggagaaagggctgtgggccacaaggtctcagtccttcctccccctgtgttacagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactggtaccagcctccctcccatcccccactgtagacacattcatgaccacccagccccacccgggagaggtggggaaatggggtggggtggaggctcaaggaagaagagagaggaagtagaatctctgagtgggcctggaagaagctatcctatttgcatacacttcacctttccttcccctcttgtgcccagtcattaaaaggaaaagcagacccaggtcctgggtggggagatcagggaaagtgaatgtttcctgcccattatcttcagtgcactatctccagngttctatccccatcctctccagatagttccctaaccaagtgaagtaggttaagaaaaaaacaagggataacatagggggaatggggttggcctatagggtcagtgggatgagagcatgggtggtggggagaaaggagcctttctcagttcttactcttcttccctgccctggtaccagccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450244 - DNA, 1704 bp, Homo sapiens
  misc_feature (1656)..(1656): n is a, c, g, or t
  misc_feature (1666)..(1666): n is a, c, g, or t
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacgtgagtgcgtgggaatctcggccctcaggaaccccagagatggccaggaacttgtcccttctacctctgcccaccagaaacctgggtatctagacccttcctcctaacctccagcccctccagggtacattcttctcacccccagggttcctgaggacatcatgtccaaccgaggcaatgacctcctgctgaagctcctgcagcatcggtatnccccgggttnatgggcagagggagggttttcgagttgttgaggcagtt

SEQ ID NO: 450245 - DNA, 688 bp, Homo sapiens
ccgggtgatggcagaggataccgatgctgcaggagcttcagcaggaggtcattgcctcggttggacatgatgtcctcaggaaccgtggtggtgatgatctcatccttggttctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450246 - DNA, 406 bp, Homo sapiens
tcattttttaaagcattatttatttggggacctttaatatgttgtacttatattttaacagaatcataatctgatgataactttgcatttacttattatgtatagacagttacatcataaaactctcagaattctgtacatacaggatatgtgtgcactgagccacaatataaaatgtttatcttacaaaggttgcagtaagaaaagtttgcaaaacactagcctggtacatatttcattaaggcttgaaagaggaaagtaaagctgtgaaggtcaggggtaaagcaggccttacagtctgtgagtgctagggctgggatggtccccagcacagtccccaggcctcaccagggttggggtttgttaacctgtgttccccacagctacctggtggcgcacaccctag

SEQ ID NO: 450247 - DNA, 467 bp, Homo sapiens
gattgtctaggtgtcttttctttcttctcaaactaacccttctccccacatgcacgcgcctgcaatccatttgaaactaggctgtggaaaaggagcaaaaatcgtccaatgctgctttcacttttgcttccaaatccagctccctgtgtttgttcccatggtcaggggtgggaaattaggttcagagtgagggtgaggaagaggagtttctgtgggggccagggatgtttcaagagagatagtcaacgagactagaaccagaggacacacagcagggcttctgaaagggaagggaaaggacctgccagtgggcagggtccttaaggaggccatctgttttggcaggatacgtactatcagccccgtgccctggagaaacatgctgacagcatcctggcactggtatgtctaccctggcatctgggactctgcatctttcagacccacctgtcctcttgaacttagcc

SEQ ID NO: 450248 - DNA, 2069 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450249 - DNA, 2758 bp, Homo sapiens
  misc_feature (1500)..(1500): n is a, c, g, or t
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactggtaccagcctccctcccatcccccactgtagacacattcatgaccacccagccccacccgggagaggtggggaaatggggtggggtggaggctcaaggaagaagagagaggaagtagaatctctgagtgggcctggaagaagctatcctatttgcatacacttcacctttccttcccctcttgtgcccagtcattaaaaggaaaagcagacccaggtcctgggtggggagatcagggaaagtgaatgtttcctgcccattatcttcagtgcactatctccagngttctatccccatcctctccagatagttccctaaccaagtgaagtaggttaagaaaaaaacaagggataacatagggggaatggggttggcctatagggtcagtgggatgagagcatgggtggtggggagaaaggagcctttctcagttcttactcttcttccctgccctggtaccagccacgtgggcagccatgtcctacccagatgttagtgccatgatcctggatgcctcctttgatgacctggtgcccttggccttgaaggtcatgccagacagctggagtgagtgcagctcccaggcctgcccttcctgggaaggggtgggctggaactgggaactgttctgagatggctcccttttcttgggtggggagtaagtcgccccattgttggaagcaggaggactcctttgtctgggggcctcagttttctttctccgtgaatagtgaggacctttatgttgggcaagggctttgtctctgccatcccttcacctttatcccactctagggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450250 - DNA, 2859 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggagtgagtgcagctcccaggcctgcccttcctgggaaggggtgggctggaactgggaactgttctgagatggctcccttttcttgggtggggagtaagtcgccccattgttggaagcaggaggactcctttgtctgggggcctcagttttctttctccgtgaatagtgaggacctttatgttgggcaagggctttgtctctgccatcccttcacctttatcccactctagggggcctggtgaccaggaccgtgaggcagcatctcaatctaaacaacgcggagcagctgtgcaggtgagggccggccagcgtccggcattgaacacctgccccccatacagctctgctgggcgctcaaaccctgaaactagtactaaagtgcaagttggtaaaaggccactggctcacatcctgagtgaccctgccaccacctcaactggcctaacccctcccaggtcccctgggactctggaccacctcaggatctggcaaccaaagggttaaggcctggcacggcaggggtctcccagcagggccagactgaaccatgccccttaaataatcccctctcacccctgagtgaagggctaggtcaagggctgtgctatagcaaggggagggtaagaatgctaccagtgcagggataggggtgggccagttgtcacccgtctccctctgagctctcccttcccactgctctgttctctgaagataccagggtcctgtactgctgatccggagaaccaaggatgagatcatcaccaccacgtgagtgcgtgggaatctcggccctcaggaaccccagagatggccaggaacttgtcccttctacctctgcccaccagaaacctgggtatctagacccttcctcctaacctccagcccctccagggtacattcttctcacccccagggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450251 - DNA, 2136 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatcaaaaaaaaaagaggggggcgtaaaaattcctcaggccagttgcgtcccttttggcaaagggccaagg

SEQ ID NO: 450252 - DNA, 1945 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450253 - DNA, 2271 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggtgagctaaggagtgggaagtgggaagggttcttgaatggccagggctcacatagggggactggggataccctataagcattggaagtggcagcttttgtagagtgggtggtggatgcggaagtggagggtggggagggagtccagtggctgcccctcccaacagtgctctgtaccccacctgtcccacctcctttcctcaggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450254 - DNA, 3061 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgccctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggagtgagtgcagctcccaggcctgcccttcctgggaaggggtgggctggaactgggaactgttctgagatggctcccttttcttgggtggggagtaagtcgccccattgttggaagcaggaggactcctttgtctgggggcctcagttttctttctccgtgaatagtgaggacctttatgttgggcaagggctttgtctctgccatcccttcacctttatcccactctagggggcctggtgaccaggaccgtgaggcagcatctcaatctaaacaacgcggagcagctgtgcaggtgagggccggccagcgtccggcattgaacacctgccccccatacagctctgctgggcgctcaaaccctgaaactagtactaaagtgcaagttggtaaaaggccactggctcacatcctgagtgaccctgccaccacctcaactggcctaacccctcccaggtcccctgggactctggaccacctcaggatctggcaaccaaagggttaaggcctggcacggcaggggtctcccagcagggccagactgaaccatgccccttaaataatcccctctcacccctgagtgaagggctaggtcaagggctgtgctatagcaaggggagggtaagaatgctaccagtgcagggataggggtgggccagttgtcacccgtctccctctgagctctcccttcccactgctctgttctctgaagataccagggtcctgtactgctgatccggagaaccaaggatgagatcatcaccaccacgtgagtgcgtgggaatctcggccctcaggaaccccagagatggccaggaacttgtcccttctacctctgcccaccagaaacctgggtatctagacccttcctcctaacctccagcccctccagggtacattcttctcacccccagggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggtgagctaaggagtgggaagtgggaagggttcttgaatggccagggctcacatagggggactggggataccctataagcattggaagtggcagcttttgtagagtgggtggtggatgcggaagtggagggtggggagggagtccagtggctgcccctcccaacagtgctctgtaccccacctgtcccacctcctttcctcaggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450255 - DNA, 618 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggtatgtctaccctggcatctgggactctgcatctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 450256 - DNA, 1205 bp, Homo sapiens
agttggtatttctcgcgagacttcaccgtctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagca

SEQ ID NO: 450257 - DNA, 3219 bp, Homo sapiens
agttggtatttctcgcgagacttcaccgtctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaaggtaacaacccccctgagggagagagtaaggcctggccgggcccgggtccctcccgaggtgaagcggaggcccaaggctgaggagcccgcctcgccggagacgcccaggcgctggccctggatcccggagccacggccgtctctcagccagagctgagcctcggcggcccggccggcgctggcctccgtgcggcggcggcaaacacggcccgcaggggaccgggtcgggtggggctgggcgccgcgcggctccctgtggagcctgcctgttggagcgcggcggggctccggcggtggtcttggagctggcgtgtggatttccacgtccgaatgatcgagttgtggcgggctttgaggtgctgcgtggcggggaggagagcagtctgggtcgctgtaactcttagggggcctttgcaggctcccagcctttggttggacgggaattttacgaaggagaagggtcctcggaaacgtggtacatttgcttataaaccatcaaaaaaggttaattggtatcttattttcaggaaaatgactgagctggatttggcgaaaggcacattcgttagaatgcctaaatgggagagtacctgtgctgttctttttgctgaagataatgcaccgataaatatttaagcgactgggcgaaagatttttgttttggagaggcacttttaaatacactcttaattgaatagttcaagtaaagatcgtagtttgtgtagttaatttaaaaacgcacttgtttggctttggaagcatactgtagtgcttaaaaataagtatttggattgtttttgaaagtttcgacttttccaacagagtagtgctttttaaaaagataacactgattattgagccgaattcagcacctaccctgtggataggagttaaaagaaaattagaaatttctttgtatctgtatgcttttttaaagtatggaatgtatctcaagtttataatcctcagaatctgttgcctttaagtttgtggtttagctgaagtctaaactgagagtaaaggtaatggtggtaaattaagctgcagtgttagaaggagttagaggcaaaaactggtaattcaggcagacaggggagttagttttttatgccttgatttttggtttagttttcatggtctaaccctttttattttccctagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctcca

SEQ ID NO: 450258 - DNA, 2414 bp, Homo sapiens
agttggtatttctcgcgagacttcaccgtctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaaggtaacaacccccctgagggagagagtaaggcctggccgggcccgggtccctcccgaggtgaagcggaggcccaaggctgaggagcccgcctcgccggagacgcccaggcgctggccctggatcccggagccacggccgtctctcagccagagctgagcctcggcggcccggccggcgctggcctccgtgcggcggcggcaaacacggcccgcaggggaccgggtcgggtggggctgggcgccgcgcggctccctgtggagcctgcctgttggagcgcggcggggctccggcggtggtcttggagctggcgtgtggatttccacgtccgaatgatcgagttgtggcgggctttgagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctcca

SEQ ID NO: 450259 - DNA, 2269 bp, Homo sapiens
agttggtatttctcgcgagacttcaccgtctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaagatgtcagaggatttagcaaagcagctggcaagctacaaagctcagctccagcaagttgaagctgcattatctggaaatggagaaaatgaagatttgctaaaattgaagaaagatttacaatggctctctgcatccccgaaacgccttccttcagtaagcagagtgcttgagtgcaccccatttgacctgctgatatgtagatcacaacacctgatgcttcctggaattgccgattactgtaactgctgcccatctgtcgatgaaggagcagtttcagaactcagacttgagggaggaaaagtaattaatgtttttgtttttcttttttaggaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctcca

SEQ ID NO: 450260 - DNA, 2854 bp, Homo sapiens
ctgaaatatgtctttaaccctaatgagatttcactggactcaagtcattttgtagtgagacattcacaatatgaccctattaacccagtctaggaagtctggggagccgaatgagtggccgcatcagacactctgaccaaaaatggtaaccagtttttgatctgaaaactcctcttaatttagctctgaacacatcaatcaagcttttgaaatgcatcctcctccttgcccctcatattttaaaccaactgttgttcacagtacagtttgcacgacatctttgttcaaacatagctcagttttgcttctactcaacctactcattcatggaaagtaggagacaagtgtatggcagtctggagtgaagatggacagtaagtgtagaaaaaaaaactctaactataacatgaaataataaaatacaatggtaagaagtttttattcagttttaactaccctattttaatcttgacttctattaggcagtatgatttatagagccaatttgattcttgggtggttgccattaatacagtttagttttagctttagattaagttttggggagaagaatggctgggattctggaggaaagaaaaacaggacaatgaatgggtgttttctaaaataatctaaattattttctctaattgaaaattgagtgaatggttggtttttctgagaattctgtgaagagcatacactgacatcattcctataagaaatatcttttcgctgggtgtggtggctcatgcctgtaatctcagcactttgggaggctgaggcaggcagatcgcttgaggtcaggagttggagagcagcctgaccaacatggtgaaaccccatctctactaaaaatacaaaaatcagttaggtgtggtggcgtgtgcctgtaatcccagctacttgggagactgaggcatgagaattgtttgaacctgggaggcggaggttgaagtgagctgagattgcactactgcactccagcctgggcgacagtgagactctgtcgcaaaaaagagaaaaaaagaaacctctattctcaaagacattaaatcacgttgagtaggtacatgtaagagacttgcccagcaatattatgattgggatgtccttttttgatagcagataactaacttcaaccactcttttgtattctctttgctgaaacaaccatttgattatagaagtttcattatagacacatgtaataattttatcactacagtataagtcttgtaggctgagtactaaacctttactcacctgcttacagccatgatatctttagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctcca

SEQ ID NO: 450261 - DNA, 1546 bp, Homo sapiens
agttggtatttctcgcgagacttcaccgtctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcaaaaaaaaaaaaaaaaaaaaaaaaaaacaaaaaaaaaaagggggggggggaaaaaaagaatccccgggggggccaaaggttaaggcttaccccggtttttttgtcacaaggggggccctatgaaggagagcgaattaaaagagaaggcgggaggggttaaaaacggtcgggacgggggaacatgggtacgttgcaatttttgggaaggaaccctacttctggtggtgggcttagttggacaactactaagagattaagggtcagggaaataaatttacgtgtttatggtaccacgaatgtgcgcgaaatgggtcggtatatagatagagggtaaaaataagg

SEQ ID NO: 450262 - DNA, 542 bp, Homo sapiens
gcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctccagggtgtgttaacaaaagggtaaagtctttagctgtcagcacttaaagcaattaaacctccaagtacttgcacacggcattcatgcaagagaatactgagtgtgtgagaggtttcagtaaatgcttaagtattccttccattagaagaaattggatcttaaagggcaaaccaggcctgtgtttataggatgtcctcattttaatgggtgtttgtagatttttggtggaaggggaaaataagtttttatttcatgaattttaattttttttataaattgaaacttaggacag

SEQ ID NO: 450263 - DNA, 2059 bp, Homo sapiens
agttggtatttctcgcgagacttcaccgtctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctcca

SEQ ID NO: 450264 - DNA, 2400 bp, Homo sapiens
agttggtatttctcgcgagacttcaccgtctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctccaaaaaaaaaaaaaaaaaaaaaaaaaaacaaaaaaaaaaagggggggggggaaaaaaagaatccccgggggggccaaaggttaaggcttaccccggtttttttgtcacaaggggggccctatgaaggagagcgaattaaaagagaaggcgggaggggttaaaaacggtcgggacgggggaacatgggtacgttgcaatttttgggaaggaaccctacttctggtggtgggcttagttggacaactactaagagattaagggtcagggaaataaatttacgtgtttatggtaccacgaatgtgcgcgaaatgggtcggtatatagatagagggtaaaaataagg

SEQ ID NO: 450265 - DNA, 2005 bp, Homo sapiens
agttggtatttctcgcgagacttcaccgtctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcaatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctcca

SEQ ID NO: 450266 - DNA, 2975 bp, Homo sapiens
agttggtatttctcgcgagacttcaccgtctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtaagtgtagaaaaaaaaactctaactataacatgaaataataaaatacaatggtaagaagtttttattcagttttaactaccctattttaatcttgacttctattaggcagtatgatttatagagccaatttgattcttgggtggttgccattaatacagtttagttttagctttagattaagttttggggagaagaatggctgggattctggaggaaagaaaaacaggacaatgaatgggtgttttctaaaataatctaaattattttctctaattgaaaattgagtgaatggttggtttttctgagaattctgtgaagagcatacactgacatcattcctataagaaatatcttttcgctgggtgtggtggctcatgcctgtaatctcagcactttgggaggctgaggcaggcagatcgcttgaggtcaggagttggagagcagcctgaccaacatggtgaaaccccatctctactaaaaatacaaaaatcagttaggtgtggtggcgtgtgcctgtaatcccagctacttgggagactgaggcatgagaattgtttgaacctgggaggcggaggttgaagtgagctgagattgcactactgcactccagcctgggcgacagtgagactctgtcgcaaaaaagagaaaaaaagaaacctctattctcaaagacattaaatcacgttgagtaggtacatgtaagagacttgcccagcaatattatgattgggatgtccttttttgatagcagataactaacttcaaccactcttttgtattctctttgctgaaacaaccatttgattatagaagtttcattatagacacatgtaataattttatcactacagtataagtcttgtaggctgagtactaaacctttactcacctgcttacagccatgatatctttagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctcca

SEQ ID NO: 450267 - DNA, 2064 bp, Homo sapiens
gtgtctgggtggggcctgggagccacaggagatgcccaaagccaggcagagcccgggggcgaggggacggcaggcaggtgtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 450268 - DNA, 1260 bp, Homo sapiens
cgcgcgggggcgggcgcgcggggccttgccggagaacctgactctccgcagcagcagtggaagccagagtgacgcgttgtgttgaacaccagttttctggagcgctgtgtgttctcatagctgagcagtctgtttctccaatcaggtttcaaagccacttcaactgcactggcccctgtgggtcactgctgcaccgccctggcccatgtgggtccctgaggagcgacctgccggggccacctggctggacgaaaaagacacaccttggacttaagccgtgagaaaaaaacttcatcagtaagaaacaagtcaatagacaagtaaaagactaggagaaaatatgcataaaacataaaaaagtgacttgattcctgattctggagtatttaagaattcctataactcaacaaaaagttcagttttttaaaatgagcaaaaggcttgggtaaactattcacaaaggaacgtagacaaatgccagtacacacatgagaagcgcatacacatccacaaacttcaaacaagcccacctcatgtatttctagtgagtaaggaaaagaacgcaaacacttttgaaaattgtttggttgtttcttgtaaatttaaacaaataccctattatattatccagcgagtccatccttaggtttttatccaaggataaagaggtgaaaactcatatctaacaaatagacttctgaaaagatgaaaatagaagctttattcataaaagacaaaaactggaaataacccaaatattcattcacaggagaatgaataaacagactaggttgaatccatacaatggaatggtagcagacaataaaaagaaaatgaactattgatgccccctactgcacagcagaagctctgaatcgtgttcctgaatgaaagaagtcaggtatgaaagaataaacattgtatgattccatttatatgaaaatgaatctgtgatttaaaaatcagactagtattaggttggtgcgaaagtaattgcggtttttgccttttttttttttttttaaatagttgctttggggtttatggatggagtggcatggtagaggttagctgaagggggcatgaaataactttttgggggtgctagagtgttgtaaatcttacagtgggggagggacaggagtgcaggcatttgacaaaacacattgaattgtgaaatttaagatttttgaatttctttgtatgtaaattacctgccaataaaaacatgacgaatagagcagttatgagcatttgtgt

SEQ ID NO: 450269 - DNA, 860 bp, Homo sapiens
  misc_feature (647)..(647): n is a, c, g, or t
gtgtctgggtggggcctgggagccacaggagatgcccaaagccaggcagagcccgggggcgaggggacggcaggcaggtgtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctgggagaatgaataaacagactaggttgaatccatacaatggaatggtagcagacaataaaaagaaaatgaactattgatgccccctactgcacagcagaagctctgaatcgtgttcctgaatgaaagaagtcagatggtgtcagagcagatctgaagtagagcttctaacgactcccaggagtgctgagtgaccgaagccaggtacctgcaggacctatttgtgttcgttgatctctcagagcagttggaagtcatggtggtgctgagtccctgggtacatggaggagcaaagacatgaacctttccctgctcctggcaactggctccatcctactccctatgggcttcatgaacttgcctgtggttggggatacttcctgcccttatgggccccaganaccctatctcttaaaaagggaaatttccctggacatctctcagttgctgtccaccctgtgaaatgaacccaggaagctactggttaggtaccctagcccggtctggccaaatcgcaagtgttctggcggtggaacacttagcatacggttggagagtccctctcggtgatgtgctagaagcaaccttatatggcaccacctcaccagggggga

SEQ ID NO: 450270 - DNA, 1964 bp, Homo sapiens
  misc_feature (3)..(3): n is a, c, g, or t
  misc_feature (11)..(11): n is a, c, g, or t
  misc_feature (24)..(24): n is a, c, g, or t
aantaggctangtacgggctgggnttgaatcggccgtgtggagtcccagcagaggccaacctgtgtctcttcatctccctgggaaaggtgcccccgaggtgaaagagatggcctggtggaaatcctggagcaggcctggttctcttgcagattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 450271 - DNA, 1866 bp, Homo sapiens
atgcagctccaggaagcctttgcttcagtgttctttcccctcctaactttggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 450272 - DNA, 1449 bp, Homo sapiens
ccatgtggccccagctgacatgagactggtcagggatgaaggtgagcaggaaggccctgcctgtgaaattcctggctgagctgattgctgccattgctctagtaggaagtcttgttcctggagcagtgagtattttgtgtctagaatctgatgtggcaaaccaaacatactgcagtttggagcacttggcatcataaaggaagagttctgggcagtgggtgagaaggaattaagggagtggacaccctaagccaccaaagcttccctcctaatgcttccctggctgaagcacaggctccttcccacatctccctccctctaaaagccccagaacccaaccacacagatccgtccatcactcagagatggacaggaaaggtgaggcaggattgttgatggctgctgtcttgcccagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 450273 - DNA, 960 bp, Homo sapiens
ccaggcacaagcaaaccccttctcacgcttatgcgcctcctgcccacaggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 450274 - DNA, 932 bp, Homo sapiens
ttgggtatctagcaggatctcgaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 450275 - DNA, 906 bp, Homo sapiens
ggatgagctcggtacctgtttgagcctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 450276 - DNA, 1276 bp, Homo sapiens
gtgtctgggtggggcctgggagccacaggagatgcccaaagccaggcagagcccgggggcgaggggacggcaggcaggtgtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaaggagcagggacgcgtgacggggacctggataacaacacatcgtcttccaggacccgaggatgacttagagtctgcagcacatggtcacctcccagcacgacgtccggacagaccctcagcagcatgagcacgcgacgaacaaccgcggcgcatacagaacgcccgccagaccaggcgggccggatcccgacggccgccagaaagccgacacacaaccccgacgccgagccccggaccccccagcaga

SEQ ID NO: 450277 - DNA, 1135 bp, Homo sapiens
  misc_feature (57)..(57): n is a, c, g, or t
ggcgcgtgcacaggatggtgatgaatttcatctcatcagtcccacgaatcttctcgncctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 450278 - DNA, 1135 bp, Homo sapiens
  misc_feature (1093)..(1093): n is a, c, g, or t
cgcgcgggggcgggcgcgcggggccttgccggagaacctgactctccgcagcagcagtggaagccagagtgacgcgttgtgttgaacaccagttttctggagcgctgtgtgttctcatagctgagcagtctgtttctccaatcaggtttcaaagccacttcaactgcactggcccctgtgggtcactgctgcaccgccctggcccatgtgggtccctgaggagcgacctgccggggccacctggctggacgaaaaagacacaccttggacttaagccgtgagaaaaaaacttcatcagtaagaaacaagtcaatagacaagtaaaagactaggagaaaatatgcataaaacataaaaaagtgacttgattcctgattctggagtatttaagaattcctataactcaacaaaaagttcagttttttaaaatgagcaaaaggcttgggtaaactattcacaaaggaacgtagacaaatgccagtacacacatgagaagcgcatacacatccacaaacttcaaacaagcccacctcatgtatttctagtgagtaaggaaaagaacgcaaacacttttgaaaattgtttggttgtttcttgtaaatttaaacaaataccctattatattatccagcgagtccatccttaggtttttatccaaggataaagaggtgaaaactcatatctaacaaatagacttctgaaaagatgaaaatagaagctttattcataaaagacaaaaactggaaataacccaaatattcattcacaggagaatgaataaacagactaggttgaatccatacaatggaatggtagcagacaataaaaagaaaatgaactattgatgccccctactgcacagcagaagctctgaatcgtgttcctgaatgaaagaagtcagggcctcatagacattcactccacccaacaaccacagaatatacattcttcctatctgtacacagaacatattctcagatcaaccatatgctgagtcataaagcaagtctcaataaattttaaaaaattgaaattataccaaacacactcttgggaccacagtgcggttaaaaataggaaacttaatatccangaggatcttcttcaaaacttacacaaatacctgggatattta

SEQ ID NO: 450279 - DNA, 794 bp, Homo sapiens
cgcgcgggggcgggcgcgcggggccttgccggagaacctgactctccgcagcagcagtggaagccagagtgacgcgttgtgttgaacaccagttttctggagcgctgtgtgttctcatagctgagcagtctgtttctccaatcaggtttcaaagccacttcaactgcactggcccctgtgggtcactgctgcaccgccctggcccatgtgggtccctgaggagcgacctgccggggccacctggctggacgaaaaagacacaccttggacttaagccgtgagaaaaaaacttcatcagtaagagagaatgaataaacagactaggttgaatccatacaatggaatggtagcagacaataaaaagaaaatgaactattgatgccccctactgcacagcagaagctctgaatcgtgttcctgaatgaaagaagtcaggtatgaaagaataaacattgtatgattccatttatatgaaaatgaatctgtgatttaaaaatcagactagtattaggttggtgcgaaagtaattgcggtttttgccttttttttttttttttaaatagttgctttggggtttatggatggagtggcatggtagaggttagctgaagggggcatgaaataactttttgggggtgctagagtgttgtaaatcttacagtgggggagggacaggagtgcaggcatttgacaaaacacattgaattgtgaaatttaagatttttgaatttctttgtatgtaaattacctgccaataaaaacatgacgaatagagcagttatgagcatttgtgt

SEQ ID NO: 450280 - DNA, 1045 bp, Homo sapiens
  misc_feature (3)..(3): n is a, c, g, or t
  misc_feature (11)..(11): n is a, c, g, or t
  misc_feature (24)..(24): n is a, c, g, or t
  misc_feature (850)..(851): n is a, c, g, or t
  misc_feature (857)..(857): n is a, c, g, or t
  misc_feature (870)..(871): n is a, c, g, or t
  misc_feature (874)..(875): n is a, c, g, or t
  misc_feature (889)..(889): n is a, c, g, or t
  misc_feature (892)..(892): n is a, c, g, or t
aantaggctangtacgggctgggnttgaatcggccgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggnnggggtnaatgccaaactcnnggnnttggggaggaactntangccgaagggcgggcccttgcctgtttaaatgtcgggcggaggcatcttagtgtacaagttggacccccggtcgggacgcgttaacccctggtcgcccgaaaacgcccctcctcggggggcggcccgaggtcccgctcgtttacgtacttctgc

SEQ ID NO: 450281 - DNA, 2149 bp, Homo sapiens
gtgtctgggtggggcctgggagccacaggagatgcccaaagccaggcagagcccgggggcgaggggacggcaggcaggtgtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggcaccaagtgcaaagccaaggagctcaaagccaccacgatcctccacacgggggagttatcttacccaaacctgtcgtggatcagaaaggttttagttctcggaggtgaaattgagtctgggaaagggacgctgcatctccagagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 450282 - DNA, 1283 bp, Homo sapiens
  misc_feature (3)..(3): n is a, c, g, or t
  misc_feature (11)..(11): n is a, c, g, or t
  misc_feature (24)..(24): n is a, c, g, or t
aantaggctangtacgggctgggnttgaatcggcctgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 450283 - DNA, 1167 bp, Homo sapiens
  misc_feature (972)..(973): n is a, c, g, or t
  misc_feature (979)..(979): n is a, c, g, or t
  misc_feature (992)..(993): n is a, c, g, or t
  misc_feature (996)..(997): n is a, c, g, or t
  misc_feature (1011)..(1011): n is a, c, g, or t
  misc_feature (1014)..(1014): n is a, c, g, or t
gtgtctgggtggggcctgggagccacaggagatgcccaaagccaggcagagcccgggggcgaggggacggcaggcaggtgtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggnnggggtnaatgccaaactcnnggnnttggggaggaactntangccgaagggcgggcccttgcctgtttaaatgtcgggcggaggcatcttagtgtacaagttggacccccggtcgggacgcgttaacccctggtcgcccgaaaacgcccctcctcggggggcggcccgaggtcccgctcgtttacgtacttctgc

SEQ ID NO: 450284 - DNA, 153 bp, Homo sapiens
ccacattcacaacaagtgtagggtttctctcctgtgtgcaacctctggtgggtgcgaagattagagccataactgaatcccttgccacactgatcacacgtatagggcttttttcccgtgtggactcgctgatgtttgtgaaggcttgatgtg

SEQ ID NO: 450285 - DNA, 2303 bp, Homo sapiens
  misc_feature (86)..(86): n is a, c, g, or t
  misc_feature (2303)..(2303): n is a, c, g, or t
ttgaaaagggtatcattcatgtggtttcagtttagaagagtccctcagagctttgcctcaagcaatttcaaattgtagtgataccntaaatcatgtattcaggatgccttctttagcatttagaaccccaactagacttatactttgactaaagtcagaggcagaccaatttagggaacagattttgttctttgcttttatgatacatttgtaactcacagctgttagcatgacctcacatcactgcgtaggacccggaaatcacatctcctggtcaggtcacgagaaagaacacaggcttgactattgtccagaagttactttccccttgactaaaggtttccccttagggtacacattgctatttaactttgcctcctacccttttttgttaccttccgcctgtctcctgttgattcgcagatgtaatatcgagtattcatcaactggtctcaatttcctgaacacattcactgtatccctcattgtaaccgttatccccctgcttcaaaatgtgccagttccacttggtaataacgttgggaaaatgcaggtttatgaatgatgtggacttttagaggatcaaatcaataaattggattttttattttttgagggcagctgcctcactgttttaaataaagaatcttacataagaatgttgacaacattcacagtaagccattggcagaaaattgatctgcatgtcctagaccaatgattacaaggtgtctgtgggtctgtggtttagggggcccagcccatcattccttttccccttggcactcatgagagagatgccaagttcagtgtggatttttcttggtgctctatggagaaatggagtctgtgtgcttactgaagagtcccaaaaaccagagaccattttcatttactgccatcataaatattctccaccattcaagatgcctgtgtacacggctatttgggaaacttaagtgttggaggaggcaggggctgaaggtgtcaaaacctcctcagtaggataacccctttctcccctttggaccatctgccatctttcatgagtgtttcccatggtgtttttgcatccagagttgacaacaactcaattttgccttgaatttactcagtcttataaattaaaaatgtgcattttatataaagatgcattttatataaaaatgcacacctttaatctctatatggcagcatatacatatatatatatatataaaatgcacacttttaatctctatatggcagcatttttgaggctttatatctgcccgtgtaccctcaactgcctcctttttgcagagaacgatccccacaggaactggtctaagaacactgtctgcacatgattgatgcttaaaatccaatataccaccacatatcaaaggttgggattttcagagtccttcttgatttctgagctgaaaccttaacaaatagggaatttggcagggaagacacctgggtttttaattcagaaccctatttatatactgttaaaatttgaggtactatagtttatataaaagtcggatgttaagatattatatttcagtactaggagcttctttgcagtcattaacatgacaaattaagtaataaatataaaagtgattgtccataaattatcattgaattttttgtttattttgtagtgttctgtatttatctgcactttgtgtatatatacacacatacatatgccaacatgtaaataacctcatgtttattcctaatctaaattgccacaatatttttaatgtatggttacactgtgttttaaattactttaaaaataaactttgtaagcagaaaaaaaaaaaaaaaaaaaaaaaaaaaaaaaaaaaaaaaaaaaaaaaaaaagaaaaaaaaaaaataaaagaaaaaaagactaagaacagaaaaaacgaaacaaaaagagagaggggggcgcgccgcgacaataaaatacccccgaggaggggccaccaaatcattaagaggcaacacccagctttgttaggtgaacagggggggcaccaccatagaggaagggaaggattaaaaagaacagagcagacgcggagcggcgggcgtataataaaacacagcggcgaggcagggggagaaaacaaccagctagcgagagtaatcatttggaggagaagacacccacaagcggtgggggggcaacaacagaggagaaacacacacaccagaaatataaaaacgccgggggatatataaacgcggggggtcaggggtaaacacggacgatatgctgcgggaaaaaatgcgaacgcgagatgtaggaaaatacagan

SEQ ID NO: 450286 - DNA, 2304 bp, Homo sapiens
  misc_feature (86)..(86): n is a, c, g, or t
  misc_feature (2304)..(2304): n is a, c, g, or t
ttgaaaagggtatcattcatgtggtttcagtttagaagagtccctcagagctttgcctcaagcaatttcaaattgtagtgataccntaaatcatgtattcaggatgccttctttagcatttagaaccccaactagacttatactttgactaaagtcagaggcagaccaatttagggaacagattttgttctttgcttttatgatacatttgtaactcacagctgttagcatgacctcacatcactgcgtaggacccggaaatcacatctcctggtcaggtcacgagaaagaacacaggcttgactattgtccagaagttactttccccttgactaaaggtttccccttagggtacacattgctatttaactttgcctcctacccttttttgttaccttccaaaatcaagacacttttaagaaacaaagatagttttctgaacattctgtgtcctgcctgtctcctgttgattcgcagatgtaatatcgagtattcatcaactggtctcaatttcctgaacacattcactgtatccctcattgtaaccgttatccccctgcttcaaaatgtgccagttccacttggtaataacgttgggggattttttattttttgagggcagctgcctcactgttttaaataaagaatcttacataagaatgttgacaacattcacagtaagccattggcagaaaattgatctgcatgtcctagaccaatgattacaaggtgtctgtgggtctgtggtttagggggcccagcccatcattccttttccccttggcactcatgagagagatgccaagttcagtgtggatttttcttggtgctctatggagaaatggagtctgtgtgcttactgaagagtcccaaaaaccagagaccattttcatttactgccatcataaatattctccaccattcaagatgcctgtgtacacggctatttgggaaacttaagtgttggaggaggcaggggctgaaggtgtcaaaacctcctcagtaggataacccctttctcccctttggaccatctgccatctttcatgagtgtttcccatggtgtttttgcatccagagttgacaacaactcaattttgccttgaatttactcagtcttataaattaaaaatgtgcattttatataaagatgcattttatataaaaatgcacacctttaatctctatatggcagcatatacatatatatatatatataaaatgcacacttttaatctctatatggcagcatttttgaggctttatatctgcccgtgtaccctcaactgcctcctttttgcagagaacgatccccacaggaactggtctaagaacactgtctgcacatgattgatgcttaaaatccaatataccaccacatatcaaaggttgggattttcagagtccttcttgatttctgagctgaaaccttaacaaatagggaatttggcagggaagacacctgggtttttaattcagaaccctatttatatactgttaaaatttgaggtactatagtttatataaaagtcggatgttaagatattatatttcagtactaggagcttctttgcagtcattaacatgacaaattaagtaataaatataaaagtgattgtccataaattatcattgaattttttgtttattttgtagtgttctgtatttatctgcactttgtgtatatatacacacatacatatgccaacatgtaaataacctcatgtttattcctaatctaaattgccacaatatttttaatgtatggttacactgtgttttaaattactttaaaaataaactttgtaagcagaaaaaaaaaaaaaaaaaaaaaaaaaaaaaaaaaaaaaaaaaaaaaaaaaaagaaaaaaaaaaaataaaagaaaaaaagactaagaacagaaaaaacgaaacaaaaagagagaggggggcgcgccgcgacaataaaatacccccgaggaggggccaccaaatcattaagaggcaacacccagctttgttaggtgaacagggggggcaccaccatagaggaagggaaggattaaaaagaacagagcagacgcggagcggcgggcgtataataaaacacagcggcgaggcagggggagaaaacaaccagctagcgagagtaatcatttggaggagaagacacccacaagcggtgggggggcaacaacagaggagaaacacacacaccagaaatataaaaacgccgggggatatataaacgcggggggtcaggggtaaacacggacgatatgctgcgggaaaaaatgcgaacgcgagatgtaggaaaatacagan

SEQ ID NO: 450287 - DNA, 2357 bp, Homo sapiens
  misc_feature (86)..(86): n is a, c, g, or t
  misc_feature (2357)..(2357): n is a, c, g, or t
ttgaaaagggtatcattcatgtggtttcagtttagaagagtccctcagagctttgcctcaagcaatttcaaattgtagtgataccntaaatcatgtattcaggatgccttctttagcatttagaaccccaactagacttatactttgactaaagtcagaggcagaccaatttagggaacagattttgttctttgcttttatgatacatttgtaactcacagctgttagcatgacctcacatcactgcgtaggacccggaaatcacatctcctggtcaggtcacgagaaagaacacaggcttgactattgtccagaagttactttccccttgactaaaggtttccccttagggtacacattgctatttaactttgcctcctacccttttttgttaccttccaaaatcaagacacttttaagaaacaaagatagttttctgaacattctgtgtcctgcctgtctcctgttgattcgcagatgtaatatcgagtattcatcaactggtctcaatttcctgaacacattcactgtatccctcattgtaaccgttatccccctgcttcaaaatgtgccagttccacttggtaataacgttgggaaaatgcaggtttatgaatgatgtggacttttagaggatcaaatcaataaattggattttttattttttgagggcagctgcctcactgttttaaataaagaatcttacataagaatgttgacaacattcacagtaagccattggcagaaaattgatctgcatgtcctagaccaatgattacaaggtgtctgtgggtctgtggtttagggggcccagcccatcattccttttccccttggcactcatgagagagatgccaagttcagtgtggatttttcttggtgctctatggagaaatggagtctgtgtgcttactgaagagtcccaaaaaccagagaccattttcatttactgccatcataaatattctccaccattcaagatgcctgtgtacacggctatttgggaaacttaagtgttggaggaggcaggggctgaaggtgtcaaaacctcctcagtaggataacccctttctcccctttggaccatctgccatctttcatgagtgtttcccatggtgtttttgcatccagagttgacaacaactcaattttgccttgaatttactcagtcttataaattaaaaatgtgcattttatataaagatgcattttatataaaaatgcacacctttaatctctatatggcagcatatacatatatatatatatataaaatgcacacttttaatctctatatggcagcatttttgaggctttatatctgcccgtgtaccctcaactgcctcctttttgcagagaacgatccccacaggaactggtctaagaacactgtctgcacatgattgatgcttaaaatccaatataccaccacatatcaaaggttgggattttcagagtccttcttgatttctgagctgaaaccttaacaaatagggaatttggcagggaagacacctgggtttttaattcagaaccctatttatatactgttaaaatttgaggtactatagtttatataaaagtcggatgttaagatattatatttcagtactaggagcttctttgcagtcattaacatgacaaattaagtaataaatataaaagtgattgtccataaattatcattgaattttttgtttattttgtagtgttctgtatttatctgcactttgtgtatatatacacacatacatatgccaacatgtaaataacctcatgtttattcctaatctaaattgccacaatatttttaatgtatggttacactgtgttttaaattactttaaaaataaactttgtaagcagaaaaaaaaaaaaaaaaaaaaaaaaaaaaaaaaaaaaaaaaaaaaaaaaaaagaaaaaaaaaaaataaaagaaaaaaagactaagaacagaaaaaacgaaacaaaaagagagaggggggcgcgccgcgacaataaaatacccccgaggaggggccaccaaatcattaagaggcaacacccagctttgttaggtgaacagggggggcaccaccatagaggaagggaaggattaaaaagaacagagcagacgcggagcggcgggcgtataataaaacacagcggcgaggcagggggagaaaacaaccagctagcgagagtaatcatttggaggagaagacacccacaagcggtgggggggcaacaacagaggagaaacacacacaccagaaatataaaaacgccgggggatatataaacgcggggggtcaggggtaaacacggacgatatgctgcgggaaaaaatgcgaacgcgagatgtaggaaaatacagan

SEQ ID NO: 450288 - DNA, 2202 bp, Homo sapiens
caagcgcagactgccataagatggcgtccgtggcggctgcacgagcagttcctgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagatgaaatggctcaactaggtccatctccaaagcccctgctagcttttaggagcaatggcttatctgctgataccctcctgttcccagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcggaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaa

SEQ ID NO: 450289 - DNA, 442 bp, Homo sapiens
ggttgactctgaggatccccaacgatggtcctcagctacccaggccagtcctgagtagctgggactacagatgtgcacactgtcgtgactggctttcaagaaagaggctttctgtaataaacagcctttctccttgttttacttgagaatgaatattttctattggtttttatgggtgtgccccctccctccccttttaaattacttaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcaggtaacagccctttgatgccctagagtccatctgtgatggaacttggagtaataagttactgtatagaaaaagctgaggaccatcgttggc

SEQ ID NO: 450290 - DNA, 2115 bp, Homo sapiens
caagcgcagactgccataagatggcgtccgtggcggctgcacgagcagttcctgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcggaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaa

SEQ ID NO: 450291 - DNA, 1969 bp, Homo sapiens
caagcgcagactgccataagatggcgtccgtggcggctgcacgagcagttcctgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcggaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaa

SEQ ID NO: 450292 - DNA, 1230 bp, Homo sapiens
ctcatttaacttttttaatgggtctcaaaattctgtgacaaatttttggtcaagttgtttccattaaaaagtactgattttaaaaactaataacttaaaactgccacacgcaaaaaagaaaaccaaagtggtccacaaaacattctcctttccttctgaaggttttacgatgcattgttatcattaaccagtcttttactactaaacttaaatggccaattgaaacaaacagttctgagaccgttcttccaccactgattaagagtggggtggcaggtattagggataatattcatttagccttctgagctttctgggcagacttggtgaccttgccagctccagcagccttcttgtccactgctttgatgacacccaccgcaactgtctgtctcatatcacgaacagcaaagcgacccaaaggtggatagtctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcggaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaa

SEQ ID NO: 450293 - DNA, 1883 bp, Homo sapiens
caagcgcagactgccataagatggcgtccgtggcggctgcacgagcagttcctgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcggaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaa

SEQ ID NO: 450294 - DNA, 1051 bp, Homo sapiens
caagcgcagactgccataagatggcgtccgtggcggctgcacgagcagttcctgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcggaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaa

SEQ ID NO: 450295 - DNA, 1289 bp, Homo sapiens
caagcgcagactgccataagatggcgtccgtggcggctgcacgagcagttcctgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagatgaaatggctcaactaggtccatctccaaagcccctgctagcttttaggagcaatggcttatctgctgataccctcctgttcccagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagtaagtctcatgtttttctttatcctatgggtctgttttcaatagaatatagatgtcctcagctcacccagaaaatgaattttagattctgggcctgttctaagattttggatctgacctaagggaagttctataacataaatgattatccagggatattttcttgggatgtcaca

SEQ ID NO: 450296 - DNA, 763 bp, Homo sapiens
caagcgcagactgccataagatggcgtccgtggcggctgcacgagcagttcctgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgatatccttaggaaaggcagcagctgggtttggtgggtgaaagcagcccaagccaagagagaagtttctttctagtggcaatttcttctcagaaggggcacccaaggcctaaatactgatggatgccatccccatcagactatggactgaaagatacagtgtctttgtcacccaaattcttgtccttagactgtggcatcatcattctctgggaacttgttagaaatgctgattcttgggccccactccagacctactgaattagaatctgcattataacgggagtccccagtgatttatatacacattaaaatttgagaagcactgttttagtgataagaacaccaatttaagaatcagaaaatttgtgttacagtcctagaactgccttttttaccatgtgaattttactgggtaaagcatttcctt

SEQ ID NO: 450297 - DNA, 382 bp, Homo sapiens
cagtgggctcaggggcctgcaacggaccctacctcttgtagtgattctcggggccacgggcaccggcaaatccacgctggcgttgcagctaggccagcggctcggcggtgagatcgtcagcgctgactccatgcaggtatggcagtgcggctggcccgggcgcctggggaccccggaggccgcgtggacaccctgtggcaaaggtcttaaagggtgaaccccgaggcttgtaggggcggagggggtaggtaaagggagcccatacttactaagcacccgccgcatgccagacacagtgccagatgtttcccttatcatcgtctcatcaacttctcacgacgttactatttggtagatactattatctccttttatggagaaa

SEQ ID NO: 450298 - DNA, 1875 bp, Homo sapiens
caagcgcagactgccataagatggcgtccgtggcggctgcacgagcagttcctgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcggaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaa

SEQ ID NO: 450299 - DNA, 2037 bp, Homo sapiens
caagcgcagactgccataagatggcgtccgtggcggctgcacgagcagttcctgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcggaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaa

SEQ ID NO: 450300 - DNA, 1729 bp, Homo sapiens
caagcgcagactgccataagatggcgtccgtggcggctgcacgagcagttcctgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcggaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaa

SEQ ID NO: 450301 - DNA, 1312 bp, Homo sapiens
caagcgcagactgccataagatggcgtccgtggcggctgcacgagcagttcctgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcggaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaa

SEQ ID NO: 450302 - DNA, 753 bp, Homo sapiens
caagcgcagactgccataagatggcgtccgtggcggctgcacgagcagttcctgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggtaagaaagcctggcgcgctgaccccaaattcctttacaactagagagcagtcagttcttcagtttgcccagatgatgagagagatttggtaatagcagttagtggagattgatgtgttgttctagctcagcaggttgggaggccctgagttattgcttcagttcaactccct

SEQ ID NO: 450303 - DNA, 1067 bp, Homo sapiens
aacttgcaaggacacacccacagcttacaccattggctgctgtttagctcccttatataacactgtcttggggtttaaacgtaactgaaaatccacaagacagaatagccagatctcagaggagcctggctaagcaaaaccctgcagaacggctgcctaatttacagcaaccatgagtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgagggcaaacgcctgaaagaggctttacacaagaaaggctagcaaaaacactctaactggccacggacacgcaacccaatgaccaaaaccgaagcccaaactggttgacaccgacgatcctgggagtggaaccctgggcgagccaacacactctatgcacctggcgacactgtcatcagaaacaccaacactcgagacccacgccacactcgcgacagccaagtaccccaagcagacttcaccctcggcgaaccaaagcgtcagggacagagaaaaacactactcgcacacaagcgaacaggccgtagaagccagacacttcccccctttcccgcgcctaataccgacaatgcaggacgatagatccccacaaccaactccccgacccatgggcgaaacgagaccagcggcatcgagaagcccacatgggatgacaaatgcccgtgcgaaccgcgaacaccagcaattcagtccaaaccagagcgccacacacgggcaccacgatgcgcgagaccaacgggcggagaagacagcggacccccacagaggacccatgagaacacaccaagcgcaccaccgcactcgccaaacgacctaagaccaccaccgcagacccggaaccgcggccccaacaacccaaagcacccacagaaaaaccaaccaagcgcaccccaatcgagcctgcgccaca

SEQ ID NO: 450304 - DNA, 1989 bp, Homo sapiens
aacttgcaaggacacacccacagcttacaccattggctgctgtttagctcccttatataacactgtcttggggtttaaacgtaactgaaaatccacaagacagaatagccagatctcagaggagcctggctaagcaaaaccctgcagaacggctgcctaatttacagcaaccatgaggccacttaaggatgcagcaagaaggagccatctgcaatccaggaagaaattccttgccaggaaccaaattggttgtcaccttcatctaggacttctagcctcgagaacttacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccagacttacctggacaaggtggagaacatttgcaagaagctttcaaatcccttccgctatagaatggagtgtccagaaatagactgtgaggaaggatgggccttgctgaagtgtggaggaaagaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggtggctcatctagacctggcaagaatgtatatagaagcaggcaatcacagaaaagctgaagagaattttcaaaaattgttatgcatgaaaccagtggtagaagaaacaatgcaagacatacatttccactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatattagttgtgttcaacaattagtgaaacagaatgtgtgtatgcatgtaagaaagagaaatcatttgtatgagtgctatgtagtagagaaaaaatgttagttaactttgtaggaaataaaacattggacttaca

SEQ ID NO: 450305 - DNA, 610 bp, Homo sapiens
ggtgactcagaggattccgggagtagtcaaatgcaagacatacatttccactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatattagttgtgttcaacaattagtgaaacagaatgtgtgtatgcatgtaagaaagagaaatcatttgtatgagtgctatgtagtagagaaaaaatgttagttaactttgtaggaaataaaacattggacttaca

SEQ ID NO: 450306 - DNA, 1751 bp, Homo sapiens
aacttgcaaggacacacccacagcttacaccattggctgctgtttagctcccttatataacactgtcttggggtttaaacgtaactgaaaatccacaagacagaatagccagatctcagaggagcctggctaagcaaaaccctgcagaacggctgcctaatttacagcaaccatgagtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccagacttacctggacaaggtggagaacatttgcaagaagctttcaaatcccttccgctatagaatggagtgtccagaaatagactgtgaggaaggatgggccttgctgaagtgtggaggaaagaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggtggctcatctagacctggcaagaatgtatatagaagcaggcaatcacagaaaagctgaagagaattttcaaaaattgttatgcatgaaaccagtggtagaagaaacaatgcaagacatacatttccactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatatta

SEQ ID NO: 450307 - DNA, 1880 bp, Homo sapiens
aacttgcaaggacacacccacagcttacaccattggctgctgtttagctcccttatataacactgtcttggggtttaaacgtaactgaaaatccacaagacagaatagccagatctcagaggagcctggctaagcaaaaccctgcagaacggctgcctaatttacagcaaccatgagtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccagacttacctggacaaggtggagaacatttgcaagaagctttcaaatcccttccgctatagaatggagtgtccagaaatagactgtgaggaaggatgggccttgctgaagtgtggaggaaagaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggtggctcatctagacctggcaagaatgtatatagaagcaggcaatcacagaaaagctgaagagaattttcaaaaattgttatgcatgaaaccagtggtagaagaaacaatgcaagacatacatttccactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatattagttgtgttcaacaattagtgaaacagaatgtgtgtatgcatgtaagaaagagaaatcatttgtatgagtgctatgtagtagagaaaaaatgttagttaactttgtaggaaataaaacattggacttaca

SEQ ID NO: 450308 - DNA, 2199 bp, Homo sapiens
aacttgcaaggacacacccacagcttacaccattggctgctgtttagctcccttatataacactgtcttggggtttaaacgtaactgaaaatccacaagacagaatagccagatctcagaggagcctggctaagcaaaaccctgcagaacggctgcctaatttacagcaaccatgagtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccagacttacctggacaaggtggagaacatttgcaagaagctttcaaatcccttccgctatagaatggagtgtccagaaatagactgtgaggaaggatgggccttgctgaagtgtggaggaaagaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggtggctcatctagacctggcaagaatgtatatagaagcaggcaatcacagaaaagctgaagagaattttcaaaaattgttatgcatgaaaccagtggtagaagaaacaatgcaagacatacatttccactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatattagttgtgttcaacaattagtgaaacagaatgtgtgtatgcatgtaagaaagagaaatcatttgtatgagtgctatgtagtagagaaaaaatgttagttaactttgtaggaaataaaacattggacttacactaaatgtttaattcattcattttattgtgaaataaaaataaaatccttagctcctccaccaactgaacagaccctcttggccaaggagaccccagaaaccttaaaaactaagtttcccaaccatgacaagatgagagatcattcacacctcattatattccctcccttgctaactgccattggactttttccactgagttaaacagaaacccatggaaaacaaagaacagaagactcactccttggctgacttcacctagctcactccacgtagcgccacagccagactcccctcccctctgcggtttccacatgaca

SEQ ID NO: 450309 - DNA, 419 bp, Homo sapiens
gagaattatcttgtgttttttgttttgttttgttttgagatggagtcttgttctgtcacccaggctggagcgcagtgacgtgatctcggctcactgcaaccttcacctcccgggttcaagagattctcctgtctcagcctcccgagtagctgggactacaggtacgtgccaccacacctggctaatttttgtatttttagtagagacaagagttaccatgtctttgtgcttctgggtgcttctgtgtttgtttctggccgcgtttctgtgttggacaggggtgactttgtgtgcttttgttttaatttttttgttgttttgtttttaactcttgagagtgtggcatcactcactcattatctgttgactggaatgcatgagattcaacatttcttcataccttatgatactctaagtac

SEQ ID NO: 450310 - DNA, 3557 bp, Homo sapiens
gagaattatcttgtgttttttgttttgttttgttttgagatggagtcttgttctgtcacccaggctggagcgcagtgacgtgatctcggctcactgcaaccttcacctcccgggttcaagagattctcctgtctcagcctcccgagtagctgggactacaggtacgtgccaccacacctggctaatttttgtatttttagtagagacaagagttacaccatattggccaggatcttttgctttctatagcttcaaaatgttcttaatgttaagacattcttaatactctgaaccatatgaatttgccattttggtaagtcacagacgccagatggtggcaatttcacatggcacaacccgaaagattaacaaactatccagcagatgaaaggattttttttagtttcattgggtttactgaagaaattgtttgaattctcattgcatctccagttcaacagataatgagtgagtgatgccacactctcaagagttaaaaacaaaacaacaaaaaaattaaaacaaaagcacacaactttctctctctgtcccaaaatacatacttgcatacccccgctccagataaaatccaaagggtaaaactgtcttcatgcctgcaaattcctaaggagggcacctaaagtacttgacagcgagtgtgctgaggaaatcggcagctgttgaagtcacctcctgtgctcttgccaaatgtttgaaagggaatacactgggttaccgggtgtatgttgggaggggagcattatcagtgctcgggtgaggcaagttcggagtacccagatggagacatccgtgtctgtgtcgctctggatgcctccaagccagcgtgtgtttactttctgtgtgtgtcaccatgtctttgtgcttctgggtgcttctgtgtttgtttctggccgcgtttctgtgttggacaggggtgactttgtgccggatggcttctgtgtgagagcgcgcgcgagtgtgcatgtcggtgagctgggagggtgtgtctcagtgtctatggctgtggttcggtataagtctgagcatgtctgccagggtgtatttgtgcctgtatgtgcgtgcctcggtgggcactctcgtttccttccgaatgtggggcagtgccggtgtgctgccctctgccttgagacctcaagccgcgcaggcgcccagggcaggcaggtagcggccacagaagagccaaaagctcccgggttggctggtaaggacaccacctccagctttagccctctggggccagccagggtagccgggaagcagtggtggcccgccctccagggagcagttgggccccgcccgggccagccccaggagaaggagggcgaggggaggggagggaaaggggaggagtgcctcgccccttcgcggctgccggcgtgccattggccgaaagttcccgtacgtcacggcgagggcagttcccctaaagtcctgtgcacataacgggcagaacgcactgcgaagcggcttcttcagagcacgggctggaactggcaggcaccgcgagcccctagcacccgacaagctgagtgtgcaggacgagtccccaccacacccacaccacagccgctgaatgaggcttccaggcgtccgctcgcggcccgcagagccccgccgtgggtccgcctgctgaggcgcccccagccagtgcgcttacctgccagactgcgcgccatggggcaacccgggaacggcagcgccttcttgctggcacccaatggaagccatgcgccggaccacgacgtcacgcagcaaagggacgaggtgtgggtggtgggcatgggcatcgtcatgtctctcatcgtcctggccatcgtgtttggcaatgtgctggtcatcacagccattgccaagttcgagcgtctgcagacggtcaccaactacttcatcacttcactggcctgtgctgatctggtcatgggcctggcagtggtgccctttggggccgcccatattcttatgaaaatgtggacttttggcaacttctggtgcgagttttggacttccattgatgtgctgtgcgtcacggccagcattgagaccctgtgcgtgatcgcagtggatcgctactttgccattacttcacctttcaagtaccagagcctgctgaccaagaataaggcccgggtgatcattctgatggtgtggattgtgtcaggccttacctccttcttgcccattcagatgcactggtaccgggccacccaccaggaagccatcaactgctatgccaatgagacctgctgtgacttcttcacgaaccaagcctatgccattgcctcttccatcgtgtccttctacgttcccctggtgatcatggtcttcgtctactccagggtctttcaggaggccaaaaggcagctccagaagattgacaaatctgagggccgcttccatgtccagaaccttagccaggtggagcaggatgggcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaaggaagtttacatcctcctaaattggataggctatgtcaattctggtttcaatccccttatctactgccggagcccagatttcaggattgccttccaggagcttctgtgcctgcgcaggtcttctttgaaggcctatgggaatggctactccagcaacggcaacacaggggagcagagtggatatcacgtggaacaggagaaagaaaataaactgctgtgtgaagacctcccaggcacggaagactttgtgggccatcaaggtactgtgcctagcgataacattgattcacaagggaggaattgtagtacaaatgactcactgctgtaaagcagtttttctacttttaaagacccccccccgcccaacagaacactaaacagactatttaacttgagggtaataaacttagaataaaattgtaaaattgtatagagatatgcagaaggaagggcatccttctgccttttttatttttttaagctgtaaaaagagagaaaacttatttgagtgattatttgttatttgtacagttcagttcctctttgcatggaatttgtaagtttatgtctaaagagctttagtcctagaggacctgagtctgctatattttcatgacttttccatgtatctacctcactattcaagtattaggggtaatatattgctgctggtaatttgtatctgaaggagattttccttcctacacccttggacttgaggattttgagtatctcggacctttcagctgtgaacatggactcttcccccactcctcttatttgctcacacggggtattttaggcagggatttgaggagcagcttcagttgttttcccgagcaaagtctaaagtttacagtaaataaattgtttgaccatgccttcattgcacctgtttgtccaaaaccccttgactggagtgctgttgcctcccccactggaaaccgc

SEQ ID NO: 450311 - DNA, 1157 bp, Homo sapiens
tggggggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaaaaaaaaaaa

SEQ ID NO: 450312 - DNA, 779 bp, Homo sapiens
aaatctcaaatagctaaaagatgttttcctataacgccatccatctctgtactttaagttggactcctagaggtttctgaggcagtcacaagtttaaattcaccactgttttcatgaatatttgtgacatttctccctcattgttaacctctcttggtccagtgtatgatgtcccactcagcctctgtgctgaaataattcctctcctaggtttcttcccagccctagacaaggaggaaacagcacagaggggttgggaagagtagtctagttctgggcataaatagcatcatcttactgattcaaaatatgcattcccttccaccccacatgttgaagtaagctgtctttcaaaatgttcatttattagtcatttattttttttttttttttaaatcagtttggattcctttcttttccagcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaaaaaaaaaaa

SEQ ID NO: 450313 - DNA, 711 bp, Homo sapiens
tggggggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggtgaggcctgaggaccactctgccctcccgcggcccgggctcgcgccgggggccatttaatcccgacagcttgcggcctgacgtcgctgcggcctggcagtgaccatgtcggcgtccggcccctcggccggcgatagagttgcggctaaaatgaaaggacgcccagttacatttgcatcgtagataaagaaagagcatttagtataagcatgtccgaaatgttgcgtgggatgtaggcatactaaaaccttattcgtggcctgtctgaaatccaaatggagctgggtattctgtgtttttatttgctaaatctggcagccgtacccgcggccccgggcagggagggagcagctgggctcggccagaccctgccggcgtctggggggcctgcgaagtggaggggagacgggcagccgggcagtggccggcgttccccggagctcggaccggttggattggactccgacgctaccgctccctctgctgaactattccggatgtaaaacactagggatcggagtttttcttggttttttaatctcattctagtgaccgaga

SEQ ID NO: 450314 - DNA, 1360 bp, Homo sapiens
gtggttaagagcacggaatttcgagtcagatttccaatcttggctctatcactatcctcggagtcatggggcagtcacatcatccctgtctctgtaatggtagctgcccctggataagtgttattaggtgattcagaagggtgggctgttgcccttgcctgaggttgcagtctgcggttcccaagccccaagacccgcctcagaactaactgcatttgcttttgactcctggcctttctctagggttgggaagaacatggaaagtgacctccctgccaaataactcagaagaggagtgtcggtagccaaaagtttcttcagaatacgtgtaaaagaaatgtttttcttccatctaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaaaaaaaaaaa

SEQ ID NO: 450315 - DNA, 1555 bp, Homo sapiens
tggggggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggtgaggcctgaggaccactctgccctcccgcggcccgggctcgcgccgggggccatttaatcccgacagcttgcggcctgacgtcgctgcggcctggcagtgaccatgtcggcgtccggcccctcggccggcgatagagttgcggctaaaatgaaaggacgcccagttacatttgcatcgtagataaagaaagagcatttagtataagcatgtccgaaatgttgcgtgggatgtaggcatactaaaaccttattcgtggcctgtctgaaatccaaatggagctggggttgggaagaacatggaaagtgacctccctgccaaataactcagaagaggagtgtcggtagccaaaagtttcttcagaatacgtgtaaaagaaatgtttttcttccatctaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaaaaaaaaaaa

SEQ ID NO: 450316 - DNA, 1099 bp, Homo sapiens
gccagtcttgtctctggagtctgttctcagatccgccaccagggaggctctgtcaaggcatttaagtcaaatacttttctcagaactccacagtggcttctcacgtcaccaggaatgccaaagattgtcaaccctgtttcttttctggcttcatttcttgctccttttctttcagacactggtcttttcaccattcctcaggcctgccaggcaccatcactatccttgggtctttaccctgttactttatgaccctcatatgtacaattgcatctcaagtttgtattctccacatttctctgctgctttctctctttccattaccatctgacataggtgtatcattgtcagccttccttcctagatggaaggcagggatttttgtctgttttgtttactggtatatctccagaatttagaatgtctgccgcatagaaagtcgtcagtaaacatttacagaattcattttattatgaaagaaattttaattttgctcttaggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaaaaaaaaaaa

SEQ ID NO: 450317 - DNA, 1153 bp, Homo sapiens
gccagtcttgtctctggagtctgttctcagatccgccaccagggaggctctgtcaaggcatttaagtcaaatacttttctcagaactccacagtggcttctcacgtcaccaggaatgccaaagattgtaaaacggccacaggcttcgtaagacatggagcctgtgtgacttgatgttgggcccaaccctgtttcttttctggcttcatttcttgctccttttctttcagacactggtcttttcaccattcctcaggcctgccaggcaccatcactatccttgggtctttaccctgttactttatgaccctcatatgtacaattgcatctcaagtttgtattctccacatttctctgctgctttctctctttccattaccatctgacataggtgtatcattgtcagccttccttcctagatggaaggcagggatttttgtctgttttgtttactggtatatctccagaatttagaatgtctgccgcatagaaagtcgtcagtaaacatttacagaattcattttattatgaaagaaattttaattttgctcttaggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaaaaaaaaaaa

SEQ ID NO: 450318 - DNA, 1179 bp, Homo sapiens
tggggggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgtttggattcctttcttttccagcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaaaaaaaaaaa

SEQ ID NO: 450319 - DNA, 2011 bp, Homo sapiens
tggggggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtggtaagtaatttttttaaatgtttttggttgagaacatagcaagagggggaaagttgtaacagtagtacaaacagctgcttttatggaacacttacaggcactatcctaagtattttatgtgcattatctcatttaatcttcatgacaattacacaggtttgtttctgttttcaaatgaggaaactgaggcagagagattaagcaacttacccatggtcatgcagctagaaaatggcctagctggtatataacagattttatactttcaaggaaacatgttaaaccatactggttatctccagatgacttgcaggaatccaagaccattcactcctcttctcccatgctttcaggttgtgggttaccagcaggagggtagagcgaagaaaggtggggcccagcatcttgttacataggtctatgaactgaagttctctaaagccttttgaatcataactttttgccccattcttagttttcatgattaccgtatggttctgtagacaatcacagaagatcgggcccaacatttattgtcctcaggacatgtttgcagatttactgttaaatcctgttgtcagttcatttttcttaatatgaatgaggaacatatattatttttcatttatgttaagaaatgatcccattaaataaagccaaataaaatctagagactgcgctgtacgtttcttaccccttcctttcctgttactgtagatgattagggcctaactgtaaatacagatggctctgactatgcctggctccggagttattcccaccccggttctctccccccttggctggtttgtcagggaacacttaaccccttcattgtaatgccttgtttggggagtgctttctctagtccaggggagatgtttgtgtcatttctaatgaattttgaaagtgttttgtgatgagaacactgcagcactgtggtttctctaagtggttatttgaacactcctggtaacgacctataccacttagaatagttggagtacagctcagtttgtttaagaacttcctatatgagaaatacttaggtcgggatgcatggggtagggtcccgctaactaagcagtgagcaagaaacatcaatatttggagccagacttttatatttaagagtttcagttcttttctgaagcctgggctactagttgagctcacaccctcttaaagtgggggtataatgctttacactg

SEQ ID NO: 450320 - DNA, 915 bp, Homo sapiens
tggggggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaaaaaaaaaaa

SEQ ID NO: 450321 - DNA, 842 bp, Homo sapiens
tggggggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtgacgaagtcccactctgtcacccaggctggagtgcaatggtgtgatctcagctcactgcaacctccgcctcccgggttcaagcgaatctcctgcctcagccttctgagtagctgggattacaggcacacaccaccacacttggctaattttcatacttttagtagagacagggttttgccatttggccaggctggtctcaaactcctgacctcaggtgatcctcccgcctcagcctcccaaagtgctgggattacaggcgtgagccaccgcgcccagcaaatacc

SEQ ID NO: 450322 - DNA, 1270 bp, Homo sapiens
tggggggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccagggttgggaagaacatggaaagtgacctccctgccaaataactcagaagaggagtgtcggtagccaaaagtttcttcagaatacgtgtaaaagaaatgtttttcttccatctaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaaaaaaaaaaa

SEQ ID NO: 450323 - DNA, 1291 bp, Homo sapiens
gtggttaagagcacggaatttcgagtcagatttccaatcttggctctatcactatcctcggagtcatggggcagtcacatcatccctgtctctgtaatggtagctgcccctggataagtgttattaggtgattcagaagggtgggctgttgcccttgcctgaggttgcagtctgcggttcccaagccccaagacccgcctcagaactaactgcatttgcttttgactcctggcctttctctagggttgggaagaacatggaaagtgacctccctgccaaataactcagaagaggagtgtcggtagccaaaagtttcttcagaatacgtgtaaaagaaatgtttttcttccatctaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaatgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaaaaaaaaaaa

SEQ ID NO: 450324 - DNA, 1184 bp, Homo sapiens
gccagtcttgtctctggagtctgttctcagatccgccaccagggaggctctgtcaaggcatttaagtcaaatacttttctcagaactccacagtggcttctcacgtcaccaggaatgccaaagattgtcaaccctgtttcttttctggcttcatttcttgctccttttctttcagacactggtcttttcaccattcctcaggcctgccaggcaccatcactatccttgggtctttaccctgttactttatgaccctcatatgtacaattgcatctcaagtttgtattctccacatttctctgctgctttctctctttccattaccatctgacataggtgtatcattgtcagccttccttcctagatggaaggcagggatttttgtctgttttgtttactggtatatctccagaatttagaatgtctgccgcatagaaagtcgtcagtaaacatttacagaattcattttattatgaaagaaattttaattttgctcttaggttcatctctaacaagtatttagtgaaacgacagagcagagactatgatgtggaatggggctatgcttttgatgtgcatctcaatgctttttatccactcctggtcattttgcattttatccagctttttttcatcaaccgtaagtagcagttaattagagtattatccaagtcttcattgcatgcattggtaaagggactcatggtctgcgtctcttctggcagatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaaaaaaaaaaa

SEQ ID NO: 450325 - DNA, 2096 bp, Homo sapiens
tggggggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccgtaagtagcagttaattagagtattatccaagtcttcattgcatgcattggtaaagggactcatggtctgcgtctcttctggcagatgttatcctgacagacacatttattggatatttagttggaaataccttatggttggttgcagttggctattatatctatgtaactttcctgggatacagtggtaagtaatttttttaaatgtttttggttgagaacatagcaagagggggaaagttgtaacagtagtacaaacagctgcttttatggaacacttacaggcactatcctaagtattttatgtgcattatctcatttaatcttcatgacaattacacaggtttgtttctgttttcaaatgaggaaactgaggcagagagattaagcaacttacccatggtcatgcagctagaaaatggcctagctggtatataacagattttatactttcaaggaaacatgttaaaccatactggttatctccagatgacttgcaggaatccaagaccattcactcctcttctcccatgctttcaggttgtgggttaccagcaggagggtagagcgaagaaaggtggggcccagcatcttgttacataggtctatgaactgaagttctctaaagccttttgaatcataactttttgccccattcttagttttcatgattaccgtatggttctgtagacaatcacagaagatcgggcccaacatttattgtcctcaggacatgtttgcagatttactgttaaatcctgttgtcagttcatttttcttaatatgaatgaggaacatatattatttttcatttatgttaagaaatgatcccattaaataaagccaaataaaatctagagactgcgctgtacgtttcttaccccttcctttcctgttactgtagatgattagggcctaactgtaaatacagatggctctgactatgcctggctccggagttattcccaccccggttctctccccccttggctggtttgtcagggaacacttaaccccttcattgtaatgccttgtttggggagtgctttctctagtccaggggagatgtttgtgtcatttctaatgaattttgaaagtgttttgtgatgagaacactgcagcactgtggtttctctaagtggttatttgaacactcctggtaacgacctataccacttagaatagttggagtacagctcagtttgtttaagaacttcctatatgagaaatacttaggtcgggatgcatggggtagggtcccgctaactaagcagtgagcaagaaacatcaatatttggagccagacttttatatttaagagtttcagttcttttctgaagcctgggctactagttgagctcacaccctcttaaagtgggggtataatgctttacactg

SEQ ID NO: 450326 - DNA, 340 bp, Homo sapiens
ccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtggtaagtgtgtttatctgagatagaattgaacgctgagtgtttctgattagattttttgttataaatgtgttgtgggtcagaatctggaaatattggaaactatttctcctttttactgaagcctcaaaaaatctcacag

SEQ ID NO: 450327 - DNA, 444 bp, Homo sapiens
cctctaagcagccgtgactctcaaacgagagctttcgggagaaggccacctctgacagggtgcagcccagttggcatgtggtgtcggccaggcctgcagggtgggtgaccggacaggacagtgaggggtagagagggctgcagccgagggtccctgacgatgcccagggctgaccccaccctctgttctcctccacagccacctcctaagctgcccaacggtgtgttcacccccgacttccaggagtttgtcaataaatggtaggtggagccgggctgcccacacccctggccgggacccagatgtgccactccttccgggtcctgggtggggcccgtggcccagcctgcccatccagaatcccagtgcagcgttaggcaggactcagcccaacgggaagccagattccttttcccagagctgtggggctgcagctcccggctg

SEQ ID NO: 450328 - DNA, 1816 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaacaaacaggcgcgcgcccctctaaagcaccc

SEQ ID NO: 450329 - DNA, 1968 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaaaaaatacaaacaagaaaaccaactaaaaaaactcgcgggcacttataggggggggggggaaaaaggcttcactacaggcggccaggggcacacagttgttcccgcgccccagtttttcctcgcacgggggaacaacgcgggacccaaatgaggcgcggataatccaaagcccggtaccgtag

SEQ ID NO: 450330 - DNA, 2287 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaagccaaaaaaaaaaagaaaaaaaaaataataataaacaacaaaaataaaaacacaataacaaaaaataaacaacacatttgttgcgcgcgcgcgcgccccgtcgggccccccagaaaaagactgtcttttaacacacccccgtgtgggtgtgggggggcgcgcgcgcgcgggcccccatggtgtgttatgtcacacaccgtgtggcgcatcacgtgtttcccctagagagggacacacctcgggggtcatacacaacaactaagagcggcgtgggggaatttttcgccaccatatataaaaaaaaaagcgcgggcgggggggaaaacaaaacgcgagagattgttgtttcgagacaaacaagcttgcaagagggtaggaggcgttttgcggaggagaataaatacagagggtggtgtctttctacaaaggggagagtatcacaacgaccgagagagcgtcggtatttatatcagatattttgagcgacgcaggtgtggggggtggtaa

SEQ ID NO: 450331 - DNA, 1786 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatggccggggtgcctctggggacgggcgacgctgctgtgtgtggtctcagaggctctgcttccttaggttacaaaacaaaacagggagagaaaaagcaaaagccaaaaaaaaaaagaaaaaaaaaataataataaacaacaaaaataaaaacacaataacaaaaaataaacaacacatttgttgcgcgcgcgcgcgccccgtcgggccccccagaaaaagactgtcttttaacacacccccgtgtgggtgtgggggggcgcgcgcgcgcgggcccccatggtgtgttatgtcacacaccgtgtggcgcatcacgtgtttcccctagagagggacacacctcgggggtcatacacaacaactaagagcggcgtgggggaatttttcgccaccatatataaaaaaaaaagcgcgggcgggggggaaaacaaaacgcgagagattgttgtttcgagacaaacaagcttgcaagagggtaggaggcgttttgcggaggagaataaatacagagggtggtgtctttctacaaaggggagagtatcacaacgaccgagagagcgtcggtatttatatcagatattttgagcgacgcaggtgtggggggtggtaa

SEQ ID NO: 450332 - DNA, 1886 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatgctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaagccaaaaaaaaaaagaaaaaaaaaataataataaacaacaaaaataaaaacacaataacaaaaaataaacaacacatttgttgcgcgcgcgcgcgccccgtcgggccccccagaaaaagactgtcttttaacacacccccgtgtgggtgtgggggggcgcgcgcgcgcgggcccccatggtgtgttatgtcacacaccgtgtggcgcatcacgtgtttcccctagagagggacacacctcgggggtcatacacaacaactaagagcggcgtgggggaatttttcgccaccatatataaaaaaaaaagcgcgggcgggggggaaaacaaaacgcgagagattgttgtttcgagacaaacaagcttgcaagagggtaggaggcgttttgcggaggagaataaatacagagggtggtgtctttctacaaaggggagagtatcacaacgaccgagagagcgtcggtatttatatcagatattttgagcgacgcaggtgtggggggtggtaa

SEQ ID NO: 450333 - DNA, 1577 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcaggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaacaaacaggcgcgcgcccctctaaagcaccc

SEQ ID NO: 450334 - DNA, 1500 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgagttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaacaaacaggcgcgcgcccctctaaagcaccc

SEQ ID NO: 450335 - DNA, 1332 bp, Homo sapiens
gggtttcaccatgtcagccaggatggtctcaatctgaccttgtgatccgcccgcctcaacctcccaaagtgctgggattacaggcatgggccactgcacccggcccttagttaatttctggaccaaggaattggaatctggggtctttcaggaaacgactggggattcagcaacctgccaaattgagccttggagcagcctctgagatgttagctgtggaggaggaggcccctgcttcctggggcccatcatccattcccaaaagtgctgagcattgcaggctcttcaagagctgcggtcaacaccagctccaggcctcgggctggaagcctcttcagcaagtgccgcagggaggccctgggtgggtgagccgggaggtagaattgcgtaacagctctctatccattgctgcggtcattagccatggagagggtgacgggggctgtaacggggcaagcctcccgggttccagctgccatcctcgcccctctgggctctttcctccctggctctgctgcagccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaacaaacaggcgcgcgcccctctaaagcaccc

SEQ ID NO: 450336 - DNA, 777 bp, Homo sapiens
cagcccccgcaagacgggcaccccccaagacgccagttcgtccctttccaagtttacagtggcagcgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaacaaacaggcgcgcgcccctctaaagcaccc

SEQ ID NO: 450337 - DNA, 512 bp, Homo sapiens
ctcctccaccgcctcccggtcctgcctcttggaacccccagcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaacaaacaggcgcgcgcccctctaaagcaccc

SEQ ID NO: 450338 - DNA, 1398 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgagttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctatcaaacggaacttcgggaccgtaccagcctgc

SEQ ID NO: 450339 - DNA, 889 bp, Homo sapiens
cggcaagcctcaccgagccaaatgtgtgacttctcaaaaaatgttcttgttccttttgccttttttttaattcactagaggctcaggcaaggagtagctgtcccagggaatggaacccagagtcaggcaggggagctttgtccagtgcctctgcacacccgcctccaatttaggctggcatgtggaggagggcgcctggtggtgatcagccccctgggagcccaacccccagcagaagtgaggtggccatcggcccatctcacctccatctctctccctgtgcggccggggtgcctctggggacgggcgacgctgctgtgtgtggtctcagaggctctgcttccttaggttacaaaacaaaacagggagagaaaaagcaaaagccaaaaaaaaaaagaaaaaaaaaataataataaacaacaaaaataaaaacacaataacaaaaaataaacaacacatttgttgcgcgcgcgcgcgccccgtcgggccccccagaaaaagactgtcttttaacacacccccgtgtgggtgtgggggggcgcgcgcgcgcgggcccccatggtgtgttatgtcacacaccgtgtggcgcatcacgtgtttcccctagagagggacacacctcgggggtcatacacaacaactaagagcggcgtgggggaatttttcgccaccatatataaaaaaaaaagcgcgggcgggggggaaaacaaaacgcgagagattgttgtttcgagacaaacaagcttgcaagagggtaggaggcgttttgcggaggagaataaatacagagggtggtgtctttctacaaaggggagagtatcacaacgaccgagagagcgtcggtatttatatcagatattttgagcgacgcaggtgtggggggtggtaa

SEQ ID NO: 450340 - DNA, 194 bp, Homo sapiens
gaggagatcctggggaaagtcagcatcgcggtgagtccaccgcagacccacatcgcgcccccaccgcactctgcacggacctcttccacacggccagggttccgggagccactcacagtgtggtgggggttagggtggcccctgcagaaagagagtggccaaggctgtgcccacctgctgtggagcttgaacaa

SEQ ID NO: 450341 - DNA, 1821 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaggccaaaaataaaacgagcgcgtggtcgacatatgcccttac

SEQ ID NO: 450342 - DNA, 1575 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccaactcctaagctgccaacggcgtgtacacccccggacttccaggagtactggccataaatgcctcatccagaacccaggaaaagaggcggaccccgaagaaggctccagcaaccacacacttatacaagccggcccagagggaaaaaaagagataaagccggcggagacagtagataaacacagagagagaacaacacaggaacacaaacacccgcgagagacagtgccaggcaacaaaggaccaaaggagaaagaaacagacagagtaatacacgcactaaccagaaag

SEQ ID NO: 450343 - DNA, 1602 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctgtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaacaaacaggcgcgcgcccctctaaagcaccc

SEQ ID NO: 450344 - DNA, 1320 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatcccccgtcccaaagcacagctgtgctttggcctgctgtctgcggaaagtgccctaggatacggtggcaggactggctggggttctggctccaggcccagccacagcgcctgtcagacttaccctccttgtgcctccgttcaccctgtccacacgcagggcctgcaggagcatcctgagagtgtagggtgcctgcccgccgtcccaaagcaaggggatcctc

SEQ ID NO: 450345 - DNA, 1271 bp, Homo sapiens
ttttaaagttttcatactttatttcacagcgattgacacagaaacatactaaagttagtaacacggcacccatccccaccgccgcccagttcatggtgtcctgcttctacgaggactgtactgtggctgggggtggggatgggatgggggtggcgcctccaaggcaaacctggtggacctgcagaagaagctggaggagctggaacttgacgagcagcagaagaagcggctggaagcctttctcacccagaaagccaaggtcggcgaactcaaagacgatgagttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaacaaacaggcgcgcgcccctctaaagcaccc

SEQ ID NO: 450346 - DNA, 1038 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggtgagtgcgtccggggcaggggcaggggcagggcctccacggaacagagcatgttggggagaaggaagaccccctcacggcccctttcctcagaggcaacagtgcgctggcttccaggggatccttctcaaggcagtcgatgccatacaagtatgtatatgtagatgcctttggttttgttttgttttctttttgtttttttgagaggcagtctcactctgtcactcaggctagaatctagtagtggcacaatctcggctcactgcaacctccacctcccagattcaag

SEQ ID NO: 450347 - DNA, 1190 bp, Homo sapiens
tagcgggagaagccggtccgcgatcttgtggccgcccctcccctccccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcggccggggtgcctctggggacgggcgacgctgctgtgtgtggtctcagaggctctgcttccttaggttacaaaacaaaacagggagagaaaaagcaaaagccaaaaaaaaaaagaaaaaaaaaataataataaacaacaaaaataaaaacacaataacaaaaaataaacaacacatttgttgcgcgcgcgcgcgccccgtcgggccccccagaaaaagactgtcttttaacacacccccgtgtgggtgtgggggggcgcgcgcgcgcgggcccccatggtgtgttatgtcacacaccgtgtggcgcatcacgtgtttcccctagagagggacacacctcgggggtcatacacaacaactaagagcggcgtgggggaatttttcgccaccatatataaaaaaaaaagcgcgggcgggggggaaaacaaaacgcgagagattgttgtttcgagacaaacaagcttgcaagagggtaggaggcgttttgcggaggagaataaatacagagggtggtgtctttctacaaaggggagagtatcacaacgaccgagagagcgtcggtatttatatcagatattttgagcgacgcaggtgtggggggtggtaa

SEQ ID NO: 450348 - DNA, 3299 bp, Homo sapiens
gggggcccgggtggtaaatcaaggcaggggggagcggtcagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggtttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcacta

SEQ ID NO: 450349 - DNA, 3743 bp, Homo sapiens
cggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggtttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatgctctttttctaaccgtcaccccctctttttttttttggtattgcctgacaacatgatgaatcacctccatgtttataagttttatgttttcagctgggcacagtggctcacgcctgtaatcccagcactttgggaggccgaggcaggcggatcatgaggtcaggagatcgagactatcctggctaacacagtgaaatcccatctctactaaaaatacaaaaaatagttagctgggtgtggtggtacgcacctgtaatcccagctactcgggtggctgaggcaggagaatcgcttgaacccaggaagtggaggttgcagtgagccaagatcatgccactgcactccagcctgggcaacagagcgagacttgtctcaaaaaataataatgg

SEQ ID NO: 450350 - DNA, 3944 bp, Homo sapiens
tggcggacaaccgggcctacgagtagctaaacggcaggggggacccaaacaggggagaagggtgaacatcttaactcggttctgaaacagggagtcttgggttacctcggaaaaggcgaagttcctcgagggaaaaggaagggagcggctgggggggcggttggggggggcccggaaaatggatcccaggcccaggcggggccctagcggggcctgagccggggaacgactgcgtctccgaagaaaggtgccaaagaaggctaggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggtttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatgctctttttctaaccgtcaccccctctttttttttttggtattgcctgacaacatgatgaatcacctccatgtttataagttttatgttttcagctgggcacagtggctcacgcctgtaatcccagcactttgggaggccgaggcaggcggatcatgaggtcaggagatcgagactatcctggctaacacagtgaaatcccatctctactaaaaatacaaaaaatagttagctgggtgtggtggtacgcacctgtaatcccagctactcgggtggctgaggcaggagaatcgcttgaacccaggaagtggaggttgcagtgagccaagatcatgccactgcactccagcctgggcaacagagcgagacttgtctcaaaaaataataatgg

SEQ ID NO: 450351 - DNA, 4589 bp, Homo sapiens
ccctcctttttttttctcttttcgcgaggggatatactaaacactacgcgcgtttggccccctccctcaaatatatttccgccccaatttaatctccccccccaatttttttttttttcctaaacttcacttaggatccccaagctgtcacaaaccacaactttggagccccttcattgcttatctatctgaatttagaccccagagtctgcctctattttcccacaattctcattggtagactccgccagagcactcatcaccccctggttcctcaatgggtgtatttgtttcaccattcactgccttcatccttcccactggaaagctcctgttgaatttcccggaatttactgaccacgaaagacctaaaaatctgctcgatgttggtcgccatggcgtccgctccgttctctcaactcctcctcgctagtcctccaggctcccagcatgcctcgggaggaggcgcacgggccaattcggtctctcgccttcctgattggctccaaagggaatgcccggtccggcccgctccaccgagggaccaatcagtgagcacggccctgctctcctctgctgtttctgagcggctggggtagaggtgctgacgtttgcgccgcgcacgactatgtccgccatgttagtgtctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtggcgccaagttcagtttcgacagggatatgcatccgggagagaatttttcagcccccgcccccactggcatgtgagaggaggaactcgctgttgccctgtgtcttccccaacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggtttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatgctctttttctaaccgtcaccccctctttttttttttggtattgcctgacaacatgatgaatcacctccatgtttataagttttatgttttcagctgggcacagtggctcacgcctgtaatcccagcactttgggaggccgaggcaggcggatcatgaggtcaggagatcgagactatcctggctaacacagtgaaatcccatctctactaaaaatacaaaaaatagttagctgggtgtggtggtacgcacctgtaatcccagctactcgggtggctgaggcaggagaatcgcttgaacccaggaagtggaggttgcagtgagccaagatcatgccactgcactccagcctgggcaacagagcgagacttgtctcaaaaaataataatgg

SEQ ID NO: 450352 - DNA, 3826 bp, Homo sapiens
  misc_feature (1663)..(1663): n is a, c, g, or t
cggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggtttgctggtctttttgatttaaaagcagctggtttcaaagatccccttctggcctctggaacagatggcgttggaactaaactaaaggtgttaagagcagctaatcaaatggataagatacaattttgaacttattccctaatntggatgtttatattgttcttacatagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatgctctttttctaaccgtcaccccctctttttttttttggtattgcctgacaacatgatgaatcacctccatgtttataagttttatgttttcagctgggcacagtggctcacgcctgtaatcccagcactttgggaggccgaggcaggcggatcatgaggtcaggagatcgagactatcctggctaacacagtgaaatcccatctctactaaaaatacaaaaaatagttagctgggtgtggtggtacgcacctgtaatcccagctactcgggtggctgaggcaggagaatcgcttgaacccaggaagtggaggttgcagtgagccaagatcatgccactgcactccagcctgggcaacagagcgagacttgtctcaaaaaataataatgg

SEQ ID NO: 450353 - DNA, 4171 bp, Homo sapiens
cggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtaggcccacccacattactatggaagccacctatagagtaactttctacttttgataaaacttattttccattcccttttttttttttttttaccactttttaatggaccattttttaaatgtttatgatttttccaaaactttgattattagaagtttatgtagtagattttatatttgtaatacagtgtcttcatcatagattttctttctctcttttttttttttttcttttttaatgaaggtattctctatgctggaataatgctgaccaagaatggcccaaaagttctagagtttaattgccgttttggtgatccagagtgccaagtgggtaaaaatatcaaagtattacttggtagaagatatgtggtattttaatcttggaatttatcagcctggaagtaattacctttgggaaattcatgcaagttctgctagtacaccagtgaataaaatgtttaaggaaaactaaaatttatcccacctgccatgtggattatgtttttccaggtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggtttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatgctctttttctaaccgtcaccccctctttttttttttggtattgcctgacaacatgatgaatcacctccatgtttataagttttatgttttcagctgggcacagtggctcacgcctgtaatcccagcactttgggaggccgaggcaggcggatcatgaggtcaggagatcgagactatcctggctaacacagtgaaatcccatctctactaaaaatacaaaaaatagttagctgggtgtggtggtacgcacctgtaatcccagctactcgggtggctgaggcaggagaatcgcttgaacccaggaagtggaggttgcagtgagccaagatcatgccactgcactccagcctgggcaacagagcgagacttgtctcaaaaaataataatgg

SEQ ID NO: 450354 - DNA, 2899 bp, Homo sapiens
cggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggtttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggtacttgctccttactcatttttagatatataattttagctgtataattttagctatacctcagccttgcctcacaagctttctgcccaccttttagtgcagccatcgctatggcaactatctttacacagatgtaacatgacagcacccaccccagcgataccacgtatctcttcatttctgcctcagaactaagcattcatgcatgcacagccacaccccacaggatcgcttcccaaagtaatctccctacacacaagacctcatggctctgctgtcactcagctcgattcaaggaatagcgagcaagcaccctgacaagtactgtatcagtcaggactctgcgagaagtgctagaacttggcagaggggcagaaaatccactcagattcactaacaaagacgtcacatgcttgctttggcaggacacatactaaaattggaacgatacagagaagattcacaaaaataaaaaatagaaa

SEQ ID NO: 450355 - DNA, 2890 bp, Homo sapiens
cggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggtttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggtacttgctccttactcatttttagatatataattttagctgtataattttagctatacctcagccttgcctcacaagctttctgcccaccttttagtgcagccatcgctatggcaactatctttacacagatgtaacatgacagcacccaccccagcgataccacgtatctcttcatttctgcctcagaactaagcattcatgcatgcacagccacaccccacaggatcgcttcccaaagtaatctccctacacacaagacctcatggctctgctgtcactcagctcgattcaaggaatagcgagcaagcaccctgacaagtactgtatcagtcaggactctgcgagaagtgctagaacttggcagaggggcagaaaatcttctctgtatcgttccaattttagtatgtgtcctgccaaagcaagcatgtgacgtctttgttagtgaatctgagtggattttctgtcgacgc

SEQ ID NO: 450356 - DNA, 1527 bp, Homo sapiens
cagagtatgtgtgaggctgcttagtggattgatgtccagaaaccggctttatacaaatgtaggtgttcactcagtttcacatgatcaacaacgtagagtaaaagcactctgctagataccgtggggaataaagatcaatcagggttggaccctgctaaagggataagatcaagtgggcaggagtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatgctctttttctaaccgtcaccccctctttttttttttggtattgcctgacaacatgatgaatcacctccatgtttataagttttatgttttcagctgggcacagtggctcacgcctgtaatcccagcactttgggaggccgaggcaggcggatcatgaggtcaggagatcgagactatcctggctaacacagtgaaatcccatctctactaaaaatacaaaaaatagttagctgggtgtggtggtacgcacctgtaatcccagctactcgggtggctgaggcaggagaatcgcttgaacccaggaagtggaggttgcagtgagccaagatcatgccactgcactccagcctgggcaacagagcgagacttgtctcaaaaaataataatgg

SEQ ID NO: 450357 - DNA, 1057 bp, Homo sapiens
gtgaaatactgttgctatttgaaatcatatgtcaaatatgctctcttctagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggtaaaactctaagcaagttagctgtagtgccatttcagaaactggcctaaatggctatgtagaacatttcattaaccctataagtcattcagtattcttttctctctgtgggagtgatacagtcttggtttgtattttgtttgaatcaaaactggttatagcaatactcaaattaaatggaaaaaacttcatgatagcgtaagtttggaaagtttagcaaaatcacagtggtactgatttttatttgttttctattttttttattttatatttttaatttttttaacagggtcttcctctctcgcccaagttctcatgcctcagcctcccaaatagctgggactacaggcacaggccaccacacctggctaatttttttgtattttttgtggagatggggtttcaccatgttgccaaggccagtctgaaatcctgggctcaagtgatcctcctgctttggcctcccaaaatgctgggattataggcatgagccgctgcacttggcctgatactgatttttattccttgcgttatcacatagtgttgtatttgaaacatagttcatggttttatcaaagaactgaagatgagaatactggtcatctaactttgtaatttgatttgattatactgtaaagtttgacagtctcattttatcactgcgtttgtatctattactaaaatgtattttttgacctcttactgattcattgttggtatgtacaaactgttgacttgtaaaatcaataaagtcttagttggaaatgtgggtgt

SEQ ID NO: 450358 - DNA, 1397 bp, Homo sapiens
cggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggtaggctgggtcttctgaaaaaatttacttttctattcatactgaataaataccgttttaagtttaaaaaatgttcctcacaataaggaaaatctattttgcaaacatatgggtaagttattttttataatcccatgtattataatccatctctataaaatagttatggatttacactgtaaattaaaccatgattgtattattttgaagtaaattgtaacatcctttgttgtctgccactgaaagaaaatcctcagactctagaacatataaataaattatcaagccatccatgaggacaaaagtatttgtcccacatgtcccgggtctaagagaagtaaattaatgaatgaatatgccttgtctttcgtgatcgatctttgttgttgtgggttttctgtccttgtagaagtctactttcacaagcatgctttagtatagttattacagccaaacatgtataattataatcggaagtaaggattaagtggcgataatgaaaacatctgtttttcccataccttatttgaaactggatcaccaaatcttcaggagaatattagaggtgtgtttattccgtctgtaccagtgttagctacactattgccacattaaaaataggaaacatttatatgttccctttgagtctttctgaaagggaaagaaaaattacagtactcactggttcataatacaaatgctggataatgctaaaagtcaactaagtatcaaaaacttaccaagcctctttttttaaaaaaaaaa

SEQ ID NO: 450359 - DNA, 2176 bp, Homo sapiens
cggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggtaaaactctaagcaagttagctgtagtgccatttcagaaactggcctaaatggctatgtagaacatttcattaaccctataagtcattcagtattcttttctctctgtgggagtgatacagtcttggtttgtattttgtttgaatcaaaactggttatagcaatactcaaattaaatggaaaaaacttcatgatagcgtaagtttggaaagtttagcaaaatcacagtggtactgatttttatttgttttctattttttttattttatatttttaatttttttaacagggtcttcctctctcgcccaagttctcatgcctcagcctcccaaatagctgggactacaggcacaggccaccacacctggctaatttttttgtattttttgtggagatggggtttcaccatgttgccaaggccagtctgaaatcctgggctcaagtgatcctcctgctttggcctcccaaaatgctgggattataggcatgagccgctgcacttggcctgatactgatttttattccttgcgttatcacatagtgttgtatttgaaacatagttcatggttttatcaaagaactgaagatgagaatactggtcatctaactttgtaatttgatttgattatactgtaaagtttgacagtctcattttatcactgcgtttgtatctattactaaaatgtattttttgacctcttactgattcattgttggtatgtacaaactgttgacttgtaaaatcaataaagtcttagttggaaatgtgggtgt

SEQ ID NO: 450360 - DNA, 4510 bp, Homo sapiens
ccctcctttttttttctcttttcgcgaggggatatactaaacactacgcgcgtttggccccctccctcaaatatatttccgccccaatttaatctccccccccaatttttttttttttcctaaacttcacttaggatccccaagctgtcacaaaccacaactttggagccccttcattgcttatctatctgaatttagaccccagagtctgcctctattttcccacaattctcattggtagactccgccagagcactcatcaccccctggttcctcaatgggtgtatttgtttcaccattcactgccttcatccttcccactggaaagctcctgttgaatttcccggaatttactgaccacgaaagacctaaaaatctgctcgatgttggtcgccatggcgtccgctccgttctctcaactcctcctcgctagtcctccaggctcccagcatgcctcgggaggaggcgcacgggccaattcggtctctcgccttcctgattggctccaaagggaatgcccggtccggcccgctccaccgagggaccaatcagtgagcacggccctgctctcctctgctgtttctgagcggctggggtagaggtgctgacgtttgcgccgcgcacgactatgtccgccatgttagtgtctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggtttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatgctctttttctaaccgtcaccccctctttttttttttggtattgcctgacaacatgatgaatcacctccatgtttataagttttatgttttcagctgggcacagtggctcacgcctgtaatcccagcactttgggaggccgaggcaggcggatcatgaggtcaggagatcgagactatcctggctaacacagtgaaatcccatctctactaaaaatacaaaaaatagttagctgggtgtggtggtacgcacctgtaatcccagctactcgggtggctgaggcaggagaatcgcttgaacccaggaagtggaggttgcagtgagccaagatcatgccactgcactccagcctgggcaacagagcgagacttgtctcaaaaaataataatgg

SEQ ID NO: 450361 - DNA, 4477 bp, Homo sapiens
ccctcctttttttttctcttttcgcgaggggatatactaaacactacgcgcgtttggccccctccctcaaatatatttccgccccaatttaatctccccccccaatttttttttttttcctaaacttcacttaggatccccaagctgtcacaaaccacaactttggagccccttcattgcttatctatctgaatttagaccccagagtctgcctctattttcccacaattctcattggtagactccgccagagcactcatcaccccctggttcctcaatgggtgtatttgtttcaccattcactgccttcatccttcccactggaaagctcctgttgaatttcccggaatttactgaccacgaaagacctaaaaatctgctcgatgttggtcgccatggcgtccgctccgttctctcaactcctcctcgctagtcctccaggctcccagcatgcctcgggaggaggcgcacgggccaattcggtctctcgccttcctgattggctccaaagggaatgcccggtccggcccgctccaccgagggaccaatcagtgagcacggccctgctctcctctgctgtttctgagcggctggggtagaggtgctgacgtttgcgccgcgcacgactatgtccgccatgttagtgtctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggtttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatgctctttttctaaccgtcaccccctctttttttttttggtattgcctgacaacatgatgaatcacctccatgtttataagttttatgttttcagctgggcacagtggctcacgcctgtaatcccagcactttgggaggccgaggcaggcggatcatgaggtcaggagatcgagactatcctggctaacacagtgaaatcccatctctactaaaaatacaaaaaatagttagctgggtgtggtggtacgcacctgtaatcccagctactcgggtggctgaggcaggagaatcgcttgaacccaggaagtggaggttgcagtgagccaagatcatgccactgcactccagcctgggcaacagagcgagacttgtctcaaaaaataataatgg

SEQ ID NO: 450362 - DNA, 3689 bp, Homo sapiens
cggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggtttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaattatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatgctctttttctaaccgtcaccccctctttttttttttggtattgcctgacaacatgatgaatcacctccatgtttataagttttatgttttcagctgggcacagtggctcacgcctgtaatcccagcactttgggaggccgaggcaggcggatcatgaggtcaggagatcgagactatcctggctaacacagtgaaatcccatctctactaaaaatacaaaaaatagttagctgggtgtggtggtacgcacctgtaatcccagctactcgggtggctgaggcaggagaatcgcttgaacccaggaagtggaggttgcagtgagccaagatcatgccactgcactccagcctgggcaacagagcgagacttgtctcaaaaaataataatgg

SEQ ID NO: 450363 - DNA, 2298 bp, Homo sapiens
cggacgcgtgggtcgacccacgcgtccgagcaaacagccacttccagatcaggctgtaaagttgatcttggaggtttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatgctctttttctaaccgtcaccccctctttttttttttggtattgcctgacaacatgatgaatcacctccatgtttataagttttatgttttcagctgggcacagtggctcacgcctgtaatcccagcactttgggaggccgaggcaggcggatcatgaggtcaggagatcgagactatcctggctaacacagtgaaatcccatctctactaaaaatacaaaaaatagttagctgggtgtggtggtacgcacctgtaatcccagctactcgggtggctgaggcaggagaatcgcttgaacccaggaagtggaggttgcagtgagccaagatcatgccactgcactccagcctgggcaacagagcgagacttgtctcaaaaaataataatgg

SEQ ID NO: 450364 - DNA, 1656 bp, Homo sapiens
cggacgcgtgggtcgacccacgcgtccgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatgctctttttctaaccgtcaccccctctttttttttttggtattgcctgacaacatgatgaatcacctccatgtttataagttttatgttttcagctgggcacagtggctcacgcctgtaatcccagcactttgggaggccgaggcaggcggatcatgaggtcaggagatcgagactatcctggctaacacagtgaaatcccatctctactaaaaatacaaaaaatagttagctgggtgtggtggtacgcacctgtaatcccagctactcgggtggctgaggcaggagaatcgcttgaacccaggaagtggaggttgcagtgagccaagatcatgccactgcactccagcctgggcaacagagcgagacttgtctcaaaaaataataatgg

SEQ ID NO: 450365 - DNA, 1411 bp, Homo sapiens
cggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtgggtaaaaatatcaaagtattacttggtagaagatatgtggtattttaatcttggaatttatcagcctggaagtaattacctttgggaaattcatgcaagttctgctagtacaccagtgaataaaatgtttaaggaaaactaaaatttatcccacctgccatgtggattatgtttttccaggtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacaggtgagtgtcagggagcaagaggttggagtacaacgtgacaagtgccagcaccacagca

SEQ ID NO: 450366 - DNA, 1187 bp, Homo sapiens
cggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtacttcccgaagactctgctgaagtcttgtagtagtttggttttctcagagaactcttagatgatactttctattttgttttgttttctgtttgtttgttgctatgaattatgttactaatcagcaattaaatgaggagtatcttttctggtctctaaaactaacttttcctaaaagccttttttgaagaactaaaataagccaatctaaagtatagtatgggttgaatagatcctcctattccctcctctctgcagccaatttttaacacatgggagcctgtcgtggtcttggattcatctttggatatccgtggttcagcacaaaagtgttgtctgtgtgtatctgtgtgtgtgtgt

SEQ ID NO: 450367 - DNA, 620 bp, Homo sapiens
cccgggttcacgccattctcccgcctcagcctccctcagcgtccggagtagctaggactacaggcgcccgctaccacgcccggctaatttttttgtagttttagtagagacggggtttcaccgtgttagccaggatggtctccatctcctgacctcgtgatccgcccgcctcggcctcccaaagcgttgggattacaggagtgagccaccgcgcccggccggtcacagtgtccatgtaactaactcctggttaagaggatatggatagaaggcacatgttcaacttctggcttctgtccttgaaaagtgtgatgattccatcctttgctgtcttccttcccgctgactggaatgtggacttggtagtgagctaccttggactatgtggatgaagacaaagataaaaggaaccaaggactctgatgattctgtagagaagaggaaccgtagctgctcaaacgttcatgtgaaagaagaataaactatcagatttaagccactgctattttgggtctttgtgataaacagtgtttaccatatcctaattcactattccttccatttctaggtcaaccatgttgaattaaatatagtgctctaacttgcaaaatggttttatg

SEQ ID NO: 450368 - DNA, 792 bp, Homo sapiens
ggtaatttattttctctctcaaatgccaggccccggaggatcagaatcaagtcctatagcagactcctgccaccttatgcttgtcaccaacccttctcctccaaatctgatacaccagactttctgagaacctgtgctttaatgagtaaactcacacagctgcaacaaatgctgccacctcctggcatcttttaaaaaggctggagtgcagtggcatgatctcggctcactgcaacctccgcctcccgggttcaagtgattctcctgcctcagcctcccaaatagctgtgattacagggaacccgttgttgctcagacacccgatgtggaaatttttcttctccctcagttcaaatgagataaagatcctcctctcctcacagtgaacatgaggtcacagtgtccatgtaactaactcctggttaagaggatatggatagaaggcacatgttcaacttctggcttctgtccttgaaaagtgtgatgattccatcctttgctgtcttccttcccgctgactggaatgtggacttggtagtgagctaccttggactatgtggatgaagacaaagataaaaggaaccaaggactctgatgattctgtagagaagaggaaccgtagctgctcaaacgttcatgtgaaagaagaataaactatcagatttaagccactgctattttgggtctttgtgataaacagtgtttaccatatcctaattcactattccttccatttctaggtcaaccatgttgaattaaatatagtgctctaacttgcaaaatggttttatg

SEQ ID NO: 450369 - DNA, 657 bp, Homo sapiens
ggtaatttattttctctctcaaatgccaggccccggaggatcagaatcaagtcctatagcagactcctgccaccttatgcttgtcaccaacccttctcctccaaatctgatacaccagactttctgagaacctgtgctttaatgagtaaactcacacagctgcaacaaatgctgccacctcctggcatcttttaaaaaggctggagtgcagtggcatgatctcggctcactgcaacctccgcctcccgggttcaagtgattctcctgcctcagcctcccaaatagctgtgattacagttcaaatgagataaagatcctcctctcctcacagtgaacatgaggtcacagtgtccatgtaactaactcctggttaagaggatatggatagaaggcacatgttcaacttctggcttctgtccttgaaaagtgtgatgattccatcctttgctgtcttccttcccgctgactggaatgtggacttggtagtgagctaccttggactatgtggatgaagacaaagataaaaggaaccaaggactctgatgattctgtagagaagaggaaccgtagctgctcaaacgttcatgtgaaagaagaataaaccaagatgcggccggtcttattattggggcgtatgaggaggcgagacttactgcg

SEQ ID NO: 450370 - DNA, 574 bp, Homo sapiens
atattaatacgaataacagtaacaaaagaaaagagaagagctaactgcgacgactctcttaacctccaccgctacacgctggagtgcagtggcatgatctcggctcactgcaacctccgcctcccgggttcaagtgattctcctgcctcagcctcccaaatagctgtgattacaggtcacagtgtccatgtaactaactcctggttaagaggatatggatagaaggcacatgttcaacttctggcttctgtccttgaaaagtgtgatgattccatcctttgctgtcttccttcccgctgactggaatgtggacttggtagtgagctaccttggactatgtggatgaagacaaagataaaaggaaccaaggactctgatgattctgtagagaagaggaaccgtagctgctcaaacgttcatgtgaaagaagaataaactatcagatttaagccactgctattttgggtctttgtgataaacagtgtttaccatatcctaattcactattccttccatttctaggtcaaccatgttgaattaaatatagtgctctaacttgcaaaatggttttatg

SEQ ID NO: 450371 - DNA, 402 bp, Homo sapiens
cactggtaccttttgccctttaggggaggctatgagtctgggacaggaggacaaattcagagcccaaagggggaaatggaaaatctctgggtgttccttcagcctcagcctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggcagaaaaaaaaaag

SEQ ID NO: 450372 - DNA, 299 bp, Homo sapiens
gctttggaattaggaatcccgaattcgaatcttgattttaccagtgttaggattgatttttgcctttctctgtccaagttttcttgtttctctagtggggatatttggttctcctagggctggagggatcatatgaaaattaatgcaaaagctgtgtacaggttttaagtatcaatttaaagcctggtttcagttctgtttgtcagcatgtcacaaaaagaaacatttttgctctcaacccaattttctataactcagtaattccctaaataagcaacatgtatccaagaatacctgtt

SEQ ID NO: 450373 - DNA, 6441 bp, Homo sapiens
aattcgcggccgcgtcgacagaagacgacagaagggggggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccttcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttggcccctccgttgtgggtttggctcggtactcccatgtctcccagcacagcccgtccaagaaagccctttataacaaacacctccctgaagggaagctgctcacagccagggtcctacgccttaaccaccagaagaacctggtagagctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggaaagagtgagcaagaagccaaagaaagccggcctgtcagaggaggacgacagccttgtggacgtgtactatcgggagggaaaagaggaggcagaagagacgaatgtgctgcccaaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacgataaagaaaagcaagaaagaaagggagttggagaagcagaaggcagagaaggaactgtcccgcattgaggaggcgctgatggatcctgggcggcagccagagtccgcggatgattttgaccgactggtgctgagctcccccaacagctccattctgtggctgcagtacatggctttccacctgcaggccacggagatcgagaaggcccgtgccgtggctgagagggcccttaagaccatctccttcagagaggagcaggagaagctgaacgtgtgggtggctctgctgaacctggagaacatgtacggctctcaggagtccctgaccaaggtctttgagcgagccgtgcagtacaacgagcctctcaaagtctttctccacctggctgacatctacgccaagtcagagaaattccaggaagctggtgaactctacaaccggatgctgaagcgtttccggcaggagaaagctgtgtggatcaaatacggcgccttccttctgcggaggagccaggctgcagccagtcaccgcgtgctgcagcgagccctggagtgcctgcctagcaaggagcatgtggatgtcattgccaagtttgcccagcttgagtttcagctgggggatgcagagcgggccaaagccatttttgagaacacgctgagcacctacccaaagcgcacagatgtctggtcggtctatatcgacatgaccatcaagcacggcagccagaaggacgtccgggacatctttgagcgggtcattcatctgagcttggcccccaagagaatgaagttcttcttcaagcgctacctggactacgagaagcagcatggcactgagaaggatgtgcaggcagtcaaggccaaggccctggagtatgtggaggccaagagctcagtgctagaggcctagtggcaggctggctctgtgggacactgtcaacaatgggccagcccggccccgcctcgagtgcctgggcactcggaaaactgttacctcaggactctatttaaatgctgctttttctgcagcacgcttggggaaatcctgtcaggatgaaaaggaagttgagattttttaaatccctcttcgcttgctttattttcagtaccaacttgttatctttttccttatctgaggctacctggggattgtgggcagcaggcccctggactcccagaaatgctgagggtccctcttccaggggagttccctggggagcaagagtagaggggctattcccgagggtcctgtggtcagggtcctgctttgtccctggcaggctgtcagtccagctggagggggtcagtaggctccagggagtgggccctcccctccgatcttggagtctctgggtgttccttcagcctcagcctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggcagaaaaaaaaaag

SEQ ID NO: 450374 - DNA, 4625 bp, Homo sapiens
  misc_feature (11)..(11): n is a, c, g, or t
tcgagctcggnacccatcctccctgtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccttcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttggcccctccgttgtgggtttggctcggtactcccatgtctcccagcacagcccgtccaagaaagccctttataacaaacacctccctgaagggaagctgctcacagccagggtcctacgccttaaccaccagaagaacctggtagagctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggaaagagtgagcaagaagccaaagaaagccggcctgtcagaggaggacgacagccttgtggacgtgtactatcgggagggaaaagaggaggcagaagagacgaatgtgctgcccaaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacgataaagaaaagcaagaaagaaagggagttggagaagcagaaggcagagaaggaactgtcccgcattgaggaggcgctgatggatcctgggcggcagccagagtccgcggatgattttgaccgactggtgctgagctcccccaacagctccattctgtggctgcagtacatggctttccacctgcaggccacggagatcgagaaggcccgtgccgtggctgagagggcccttaagaccatctccttcagagaggagcaggagaagctgaacgtgtgggtggctctgctgaacctggagaacatgtacggctctcaggagtccctgaccaaggtctttgagcgagccgtgcagtacaacgagcctctcaaagtctttctccacctggctgacatctacgccaagtcagagaaattccaggaagctggtgaactctacaaccggatgctgaagcgtttccggcaggagaaagctgtgtggatcaaatacggcgccttccttctgcggaggagccaggctgcagccagtcaccgcgtgctgcagcgagccctggagtgcctgcctagcaaggagcatgtggatgtcattgccaagtttgcccagcttgagtttcagctgggggatgcagagcgggccaaagccatttttgagaacacgctgagcacctacccaaagcgcacagatgtctggtcggtctatatcgacatgaccatcaagcacggcagccagaaggacgtccgggacatctttgagcgggtcattcatctgagcttggcccccaagagaatgaagttcttcttcaagcgctacctggactacgagaagcagcatggcactgagaaggatgtgcaggcagtcaaggccaaggccctggagtatgtggaggccaagagctcagtgctagaggcctagtggcaggctggctctgtgggacactgtcaacaatgggccagcccggccccgcctcgagtgcctgggcactcggaaaactgttacctcaggactctatttaaatgctgctttttctgcagcacgcttggggaaatcctgtcaggatgaaaaggaagttgagattttttaaatccctcttcgcttgctttattttcagtaccaacttgttatctttttccttatctgaggctacctggggattgtgggcagcaggcccctggactcccagaaatgctgagggtccctcttccaggggagttccctggggagcaagagtagaggggctattcccgagggtcctgtggtcagggtcctgctttgtccctggcaggctgtcagtccagctggagggggtcagtaggctccagggagtgggccctcccctccgatcttggagtctctgggtgttccttcagcctcagcctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggcagaaaaaaaaaag

SEQ ID NO: 450375 - DNA, 4138 bp, Homo sapiens
aaccaaaggaaagcctgtcttcctggtatttgttggctactcccatgaattatggtcaggtaggattattagcaaggggcttaggtctgtctgcttgtgacaagagttttcatggatactgaacatttttgcaaaaagtgattttaccttgtcagtggttccagtgctccactgtcctccgtggtgatagcacactgccagaggaaaagaacagtgagagttctttcatggtactaatccgtgtttcctttggatctctggcagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccttcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttggcccctccgttgtgggtttggctcggtactcccatgtctcccagcacagcccgtccaagaaagccctttataacaaacacctccctgaagggaagctgctcacagccagggtcctacgccttaaccaccagaagaacctggtagagctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggaaagagtgagcaagaagccaaagaaagccggcctgtcagaggaggacgacagccttgtggacgtgtactatcgggagggaaaagaggaggcagaagagacgaatgtgctgcccaaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacgataaagaaaagcaagaaagaaagggagttggagaagcagaaggcagagaaggaactgtcccgcattgaggaggcgctgatggatcctgggcggcagccagagtccgcggatgattttgaccgactggtgctgagctcccccaacagctccattctgtggctgcagtacatggctttccacctgcaggccacggagatcgagaaggcccgtgccgtggctgagagggcccttaagaccatctccttcagagaggagcaggagaagctgaacgtgtgggtggctctgctgaacctggagaacatgtacggctctcaggagtccctgaccaaggtctttgagcgagccgtgcagtacaacgagcctctcaaagtctttctccacctggctgacatctacgccaagtcagagaaattccaggaagctggtgaactctacaaccggatgctgaagcgtttccggcaggagaaagctgtgtggatcaaatacggcgccttccttctgcggaggagccaggctgcagccagtcaccgcgtgctgcagcgagccctggagtgcctgcctagcaaggagcatgtggatgtcattgccaagtttgcccagcttgagtttcagctgggggatgcagagcgggccaaagccatttttgagaacacgctgagcacctacccaaagcgcacagatgtctggtcggtctatatcgacatgaccatcaagcacggcagccagaaggacgtccgggacatctttgagcgggtcattcatctgagcttggcccccaagagaatgaagttcttcttcaagcgctacctggactacgagaagcagcatggcactgagaaggatgtgcaggcagtcaaggccaaggccctggagtatgtggaggccaagagctcagtgctagaggcctagtggcaggctggctctgtgggacactgtcaacaatgggccagcccggccccgcctcgagtgcctgggcactcggaaaactgttacctcaggactctatttaaatgctgctttttctgcagcacgcttggggaaatcctgtcaggatgaaaaggaagttgagattttttaaatccctcttcgcttgctttattttcagtaccaacttgttatctttttccttatctgaggctacctggggattgtgggcagcaggcccctggactcccagaaatgctgagggtccctcttccaggggagttccctggggagcaagagtagaggggctattcccgagggtcctgtggtcagggtcctgctttgtccctggcaggctgtcagtccagctggagggggtcagtaggctccagggagtgggccctcccctccgatcttggagtctctgggtgttccttcagcctcagcctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggcagaaaaaaaaaag

SEQ ID NO: 450376 - DNA, 2250 bp, Homo sapiens
  misc_feature (13)..(13): n is a, c, g, or t
  misc_feature (16)..(16): n is a, c, g, or t
  misc_feature (24)..(24): n is a, c, g, or t
tgcattgtggtcnccncggggtantgggatatcgtcgtacccgcgcgcctcgagtctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggaaagagtgagcaagaagccaaagaaagccggcctgtcagaggaggacgacagccttgtggacgtgtactatcgggagggaaaagaggaggcagaagagacgaatgtgctgcccaaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacgataaagaaaagcaagaaagaaagggagttggagaagcagaaggcagagaaggaactgtcccgcattgaggaggcgctgatggatcctgggcggcagccagagtccgcggatgattttgaccgactggtgctgagctcccccaacagctccattctgtggctgcagtacatggctttccacctgcaggccacggagatcgagaaggcccgtgccgtggctgagagggcccttaagaccatctccttcagagaggagcaggagaagctgaacgtgtgggtggctctgctgaacctggagaacatgtacggctctcaggagtccctgaccaaggtctttgagcgagccgtgcagtacaacgagcctctcaaagtctttctccacctggctgacatctacgccaagtcagagaaattccaggaagctggtgaactctacaaccggatgctgaagcgtttccggcaggagaaagctgtgtggatcaaatacggcgccttccttctgcggaggagccaggctgcagccagtcaccgcgtgctgcagcgagccctggagtgcctgcctagcaaggagcatgtggatgtcattgccaagtttgcccagcttgagtttcagctgggggatgcagagcgggccaaagccatttttgagaacacgctgagcacctacccaaagcgcacagatgtctggtcggtctatatcgacatgaccatcaagcacggcagccagaaggacgtccgggacatctttgagcgggtcattcatctgagcttggcccccaagagaatgaagttcttcttcaagcgctacctggactacgagaagcagcatggcactgagaaggatgtgcaggcagtcaaggccaaggccctggagtatgtggaggccaagagctcagtgctagaggcctagtggcaggctggctctgtgggacactgtcaacaatgggccagcccggccccgcctcgagtgcctgggcactcggaaaactgttacctcaggactctatttaaatgctgctttttctgcagcacgcttggggaaatcctgtcaggatgaaaaggaagttgagattttttaaatccctcttcgcttgctttattttcagtaccaacttgttatctttttccttatctgaggctacctggggattgtgggcagcaggcccctggactcccagaaatgctgagggtccctcttccaggggagttccctggggagcaagagtagaggggctattcccgagggtcctgtggtcagggtcctgctttgtccctggcaggctgtcagtccagctggagggggtcagtaggctccagggagtgggccctcccctccgatcttggagtctctgggtgttccttcagcctcagcctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggcagaaaaaaaaaag

SEQ ID NO: 450377 - DNA, 4964 bp, Homo sapiens
aagaattgcactggactgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccttcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttggcccctccgttgtgggtttggctcggtactcccatgtctcccagcacagcccgtccaagaaagccctttataacaaacacctccctgaagggaagctgctcacagccagggtcctacgccttaaccaccagaagaacctggtagagctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggaaagagtgagcaagaagccaaagaaagccggcgctgtcagtccagctggagggggtcagtaggctccagggagtgggccctcccctccgatcttggagtctctgggtgttccttcagcctcagcctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggcagaaaaaaaaaag

SEQ ID NO: 450378 - DNA, 4209 bp, Homo sapiens
aagaattgcactggactgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccttcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggcagaaaaaaaaaag

SEQ ID NO: 450379 - DNA, 3817 bp, Homo sapiens
aagaattgcactggactgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattgacacctcccattgagggccaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtaagtcttgtgcttg

SEQ ID NO: 450380 - DNA, 859 bp, Homo sapiens
aagaattgcactggactgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatggtaggtgtctagggtcggggaggaagagtggcaatgtgccttctctctgcctctgagggagcgtggtctaggccaccttttactttcagctcaattgtgacacataggagtggttctttttctggaaggaaggtctcttgggttctttgggcacttaatggacattgaagacttgaacctaatcattac

SEQ ID NO: 450381 - DNA, 396 bp, Homo sapiens
tgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtaacccttcccctagacaggtcccctttacccttggtgaccccacaaacacaaatatgaaggagcagtaagtagtggggctgcctttaggaggctgaggaagagagcacatggggcagtgggtgtgagccggctaaatggaggagacggggaacagaacagagagaaagcctcagcggggttcagcagaagctggcaagctgatggatctcaggcacgcatggaagaggtca

SEQ ID NO: 450382 - DNA, 518 bp, Homo sapiens
cccagctacttgggaggctgagctgggaggattgcttgagcccaggagattgaggctacagtgagccatgattgcgccactgcattccagcttgggtgacagagtgagaccttgtcccagaaaaaaaaaaaattcagatgagcctgctccttactaataactgcaaaggttgggaatggaaaccttcagcctgacacatctgtcttcagtggtggtgtgacagtggaacagggtgcttttgtgagcttggtttggtggagagtagggagaaatcctgacctacagattactgtgttacagagatgaagagaaatgattcagcttatttgtttctccaggtatctcccaataagtcaccccagattcgttcgaaccatcccggagctgagtgttcggccaaggtgagggggacattagcagcactgtcttacggaaagagcactgggctttggaattaggaatcccgaattcgaatcttgattttaccagtgttaggattgatttttgcctttctctgt

SEQ ID NO: 450383 - DNA, 214 bp, Homo sapiens
gtgcccatctgtgtatttggccccaaacccaccccttttgggtctttgtccctcttgtcacaacctgagtcttgggacccaagagcagggagtcaggtgcacgctgaccctgcggaacactgtgttgtggtgagggggctgtctgcttgttgggtctctgagcagtcctctccctgcagatgtggatgtcattgccaagtttgcccagcttgag

SEQ ID NO: 450384 - DNA, 6477 bp, Homo sapiens
aagaattgcactggactgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccttcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttggcccctccgttgtgggtttggctcggtactcccatgtctcccagcacagcccgtccaagaaagccctttataacaaacacctccctgaagggaagctgctcacagccagggtcctacgccttaaccaccagaagaacctggtagagctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggaaagagtgagcaagaagccaaagaaagccggcctgtcagaggaggacgacagccttgtggacgtgtactatcgggagggaaaagaggaggcagaagagacgaatgtgctgcccaaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacgataaagaaaagcaagaaagaaagggagttggagaagcagaaggcagagaaggaactgtcccgcattgaggaggcgctgatggatcctgggcggcagccagagtccgcggatgattttgaccgactggtgctgagctcccccaacagctccattctgtggctgcagtacatggctttccacctgcaggccacggagatcgagaaggcccgtgccgtggctgagagggcccttaagaccatctccttcagagaggagcaggagaagctgaacgtgtgggtggctctgctgaacctggagaacatgtacggctctcaggagtccctgaccaaggtctttgagcgagccgtgcagtacaacgagcctctcaaagtctttctccacctggctgacatctacgccaagtcagagaaattccaggaagctggtgaactctacaaccggatgctgaagcgtttccggcaggagaaagctgtgtggatcaaatacggcgccttccttctgcggaggagccaggctgcagccagtcaccgcgtgctgcagcgagccctggagtgcctgcctagcaaggagcatgtggatgtcattgccaagtttgcccagcttgagtttcagctgggggatgcagagcgggccaaagccatttttgagaacacgctgagcacctacccaaagcgcacagatgtctggtcggtctatatcgacatgaccatcaagcacggcagccagaaggacgtccgggacatctttgagcgggtcattcatctgagcttggcccccaagagaatgaagttcttcttcaagcgctacctggactacgagaagcagcatggcactgagaaggatgtgcaggcagtcaaggccaaggccctggagtatgtggaggccaagagctcagtgctagaggcctagtggcaggctggctctgtgggacactgtcaacaatgggccagcccggccccgcctcgagtgcctgggcactcggaaaactgttacctcaggactctatttaaatgctgctttttctgcagcacgcttggggaaatcctgtcaggatgaaaaggaagttgagattttttaaatccctcttcgcttgctttattttcagtaccaacttgttatctttttccttatctgaggctacctggggattgtgggcagcaggcccctggactcccagaaatgctgagggtccctcttccaggggagttccctggggagcaagagtagaggggctattcccgagggtcctgtggtcagggtcctgctttgtccctggcaggctgtcagtccagctggagggggtcagtaggctccagggagtgggccctcccctccgatcttggagtctctgggtgttccttcagcctcagcctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggcagaaaaaaaaaag

SEQ ID NO: 450385 - DNA, 6354 bp, Homo sapiens
aagaattgcactggactgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccttcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttaaccaccagaagaacctggtagagctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggaaagagtgagcaagaagccaaagaaagccggcctgtcagaggaggacgacagccttgtggacgtgtactatcgggagggaaaagaggaggcagaagagacgaatgtgctgcccaaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacgataaagaaaagcaagaaagaaagggagttggagaagcagaaggcagagaaggaactgtcccgcattgaggaggcgctgatggatcctgggcggcagccagagtccgcggatgattttgaccgactggtgctgagctcccccaacagctccattctgtggctgcagtacatggctttccacctgcaggccacggagatcgagaaggcccgtgccgtggctgagagggcccttaagaccatctccttcagagaggagcaggagaagctgaacgtgtgggtggctctgctgaacctggagaacatgtacggctctcaggagtccctgaccaaggtctttgagcgagccgtgcagtacaacgagcctctcaaagtctttctccacctggctgacatctacgccaagtcagagaaattccaggaagctggtgaactctacaaccggatgctgaagcgtttccggcaggagaaagctgtgtggatcaaatacggcgccttccttctgcggaggagccaggctgcagccagtcaccgcgtgctgcagcgagccctggagtgcctgcctagcaaggagcatgtggatgtcattgccaagtttgcccagcttgagtttcagctgggggatgcagagcgggccaaagccatttttgagaacacgctgagcacctacccaaagcgcacagatgtctggtcggtctatatcgacatgaccatcaagcacggcagccagaaggacgtccgggacatctttgagcgggtcattcatctgagcttggcccccaagagaatgaagttcttcttcaagcgctacctggactacgagaagcagcatggcactgagaaggatgtgcaggcagtcaaggccaaggccctggagtatgtggaggccaagagctcagtgctagaggcctagtggcaggctggctctgtgggacactgtcaacaatgggccagcccggccccgcctcgagtgcctgggcactcggaaaactgttacctcaggactctatttaaatgctgctttttctgcagcacgcttggggaaatcctgtcaggatgaaaaggaagttgagattttttaaatccctcttcgcttgctttattttcagtaccaacttgttatctttttccttatctgaggctacctggggattgtgggcagcaggcccctggactcccagaaatgctgagggtccctcttccaggggagttccctggggagcaagagtagaggggctattcccgagggtcctgtggtcagggtcctgctttgtccctggcaggctgtcagtccagctggagggggtcagtaggctccagggagtgggccctcccctccgatcttggagtctctgggtgttccttcagcctcagcctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggcagaaaaaaaaaag

SEQ ID NO: 450386 - DNA, 6297 bp, Homo sapiens
aagaattgcactggactgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccttcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagccttggcccctccgttgtgggtttggctcggtactcccatgtctcccagcacagcccgtccaagaaagccctttataacaaacacctccctgaagggaagctgctcacagccagggtcctacgccttaaccaccagaagaacctggtagagctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggaaagagtgagcaagaagccaaagaaagccggcctgtcagaggaggacgacagccttgtggacgtgtactatcgggagggaaaagaggaggcagaagagacgaatgtgctgcccaaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacgataaagaaaagcaagaaagaaagggagttggagaagcagaaggcagagaaggaactgtcccgcattgaggaggcgctgatggatcctgggcggcagccagagtccgcggatgattttgaccgactggtgctgagctcccccaacagctccattctgtggctgcagtacatggctttccacctgcaggccacggagatcgagaaggcccgtgccgtggctgagagggcccttaagaccatctccttcagagaggagcaggagaagctgaacgtgtgggtggctctgctgaacctggagaacatgtacggctctcaggagtccctgaccaaggtctttgagcgagccgtgcagtacaacgagcctctcaaagtctttctccacctggctgacatctacgccaagtcagagaaattccaggaagctggtgaactctacaaccggatgctgaagcgtttccggcaggagaaagctgtgtggatcaaatacggcgccttccttctgcggaggagccaggctgcagccagtcaccgcgtgctgcagcgagccctggagtgcctgcctagcaaggagcatgtggatgtcattgccaagtttgcccagcttgagtttcagctgggggatgcagagcgggccaaagccatttttgagaacacgctgagcacctacccaaagcgcacagatgtctggtcggtctatatcgacatgaccatcaagcacggcagccagaaggacgtccgggacatctttgagcgggtcattcatctgagcttggcccccaagagaatgaagttcttcttcaagcgctacctggactacgagaagcagcatggcactgagaaggatgtgcaggcagtcaaggccaaggccctggagtatgtggaggccaagagctcagtgctagaggcctagtggcaggctggctctgtgggacactgtcaacaatgggccagcccggccccgcctcgagtgcctgggcactcggaaaactgttacctcaggactctatttaaatgctgctttttctgcagcacgcttggggaaatcctgtcaggatgaaaaggaagttgagattttttaaatccctcttcgcttgctttattttcagtaccaacttgttatctttttccttatctgaggctacctggggattgtgggcagcaggcccctggactcccagaaatgctgagggtccctcttccaggggagttccctggggagcaagagtagaggggctattcccgagggtcctgtggtcagggtcctgctttgtccctggcaggctgtcagtccagctggagggggtcagtaggctccagggagtgggccctcccctccgatcttggagtctctgggtgttccttcagcctcagcctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggcagaaaaaaaaaag

SEQ ID NO: 450387 - DNA, 4527 bp, Homo sapiens
aagaattgcactggactgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccttcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttggcccctccgttgtgggtttggctcggtactcccatgtctcccagcacagcccgtccaagaaagccctttataacaaacacctccctgaagggaagctgctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggcagaaaaaaaaaag

SEQ ID NO: 450388 - DNA, 4134 bp, Homo sapiens
aagaattgcactggactgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccttcttatgtctgtccctcacaggtgtggggatgaaacagtgcctggtcggggaaggggagcggcaggaaggggtgggatgggttttcagctattgcttgagttggaggaccccttcggtattggaatcctcagaaagcctggtgtgggaccttcttggaacagtttttctcttgggctttgctctggcccagttactccactgctctctgagttacctttacctatacaggttacccttacctacacaggtgtttttctcaagtccctgggaaagagttgtccaccacttggccctgaggtccttggctacatggcagggtgatctcagtctagatggttctggatcactcagcccagataccccaagtctgggcagcctcca

SEQ ID NO: 450389 - DNA, 3137 bp, Homo sapiens
aagaattgcactggactgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagacccagctagttgttgaagccagttcttttttgtcttggtcatgagggaattaaacgttttctctggcagaaaaaaaaaag

SEQ ID NO: 450390 - DNA, 2202 bp, Homo sapiens
gcccacacaccccactccagctccggagcacccgtgctgggctgcatggggactggccggaggggcagggccaggggagcgggtaggcagagcttcgggaggagatgaggtgaaagtaattgacgctgcccagcccggcagtgggagaggcaggggatgcgtcagtgtcgcgctggagctggcagaggtgatgagcggcggagacacgcggggctgcgatcgctcgccccaggatggccgcggctcatggacctgtggccccctcttccccagaacagaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactggcgtgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctttcagatctgctggcgcttcgtctctcccgccatcatcttctttattctagttttcactgtgatccagtaccagccgatcacctacaaccactaccagtacccaggctgggccgtggccattggcttcctcatggctctgtcctccgtcctctgcatccccctctacgccatgttccggctctgccgcacagacggggacaccctcctccagcgtttgaaaaatgccacaaagccaagcagagactggggccctgccctcctggagcaccggacagggcgctacgcccccaccatagccccctctcctgaggacggcttcgaggtccagtcactgcacccggacaaggcgcagatccccattgtgggcagtaatggctccagccgcctccaggactcccggatatagcacagctgccaggggagtgccaccccacccgtgctccacgagagactgtgag

SEQ ID NO: 450391 - DNA, 1323 bp, Homo sapiens
ggaggcgctcgttacggatgcgctccttacggaggcgctcgttacggtccgtaacgagcgcccttctggagaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactggcgtgcgcgtggggaggcctcatcaccatggcttcctacaacaagttccacaataactgttaccggtgagtgctccctgctgggctgaggctgcccccttcctgcactctctgcagcctgatctcagctccagtgcagccatgggcccacgaggcctcctttcccctcatgatcttgaggttctgggaatactggttctggataaagttgttggagaatgaggagagaggtttaggcaggagagagaagagagatagggacagtgatgtcccaggggtctgtgaggactcaggcagctcaggctccttaaaaatgcccagaacagaccagaaaaggagttgggggccaggctcagtgcttcacgccgtaatcccagcactttgagaggccaaggcgggaggatcacttgagcccaggaattcaagacaagcctgggcagcatagtgagaccccatctttctttataaaacataaaaaagaaaattagctgggtgtggtggcacacacctgtagtcccagctacttaggaggctgaggtgggaggattgcttgagaccaagaggtcaaggctacagttagctgtgatagcgccattgcactccatcctggacaacagagtgagaccctgtctc

SEQ ID NO: 450392 - DNA, 168 bp, Homo sapiens
ttcagatctgctggcgcttcgtctctcccgccatcatcttcgtgagttccctggccggcccctcccttcccccgctgccccttggccatgtgtccatctcttgggacccagcggagggacagtgggagctcccgcacctggccggagctccatacccatgactctggc

SEQ ID NO: 450393 - DNA, 2364 bp, Homo sapiens
gcccacacaccccactccagctccggagcacccgtgctgggctgcatggggactggccggaggggcagggccaggggagcgggtaggcagagcttcgggaggagatgaggtgaaagtaattgacgctgcccagcccggcagtgggagaggcaggggatgcgtcagtgtcgcgctggagctggcagaggtgatgagcggcggagacacgcggggctgcgatcgctcgccccaggatggccgcggctcatggacctgtggccccctcttccccagaacaggtgacgcttctccctgttcagagatccttcttcctgccacccttttctggagccactccctctacttccctagcagagtctgtcctcaaagtctggcatggggcctacaactctggtctccttccccaactcatggcccagcactccctagccatggcccagaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactggcgtgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctttcagatctgctggcgcttcgtctctcccgccatcatcttctttattctagttttcactgtgatccagtaccagccgatcacctacaaccactaccagtacccaggctgggccgtggccattggcttcctcatggctctgtcctccgtcctctgcatccccctctacgccatgttccggctctgccgcacagacggggacaccctcctccagcgtttgaaaaatgccacaaagccaagcagagactggggccctgccctcctggagcaccggacagggcgctacgcccccaccatagccccctctcctgaggacggcttcgaggtccagtcactgcacccggacaaggcgcagatccccattgtgggcagtaatggctccagccgcctccaggactcccggatatagcacagctgccaggggagtgccaccccacccgtgctccacgagagactgtgag

SEQ ID NO: 450394 - DNA, 753 bp, Homo sapiens
ggaggcgctcgttacggatgcgctccttacggaggcgctcgttacggtccgtaacgagcgcccttctggagaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactggcgtgcgcgtaagggccagcaacgcgcgtaaggtccagcaaccgtgcgtaagggccagcagg

SEQ ID NO: 450395 - DNA, 5677 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaaaaagtcgacgcggccgcgaatttagtagtagta

SEQ ID NO: 450396 - DNA, 5673 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450397 - DNA, 5567 bp, Homo sapiens
  misc_feature (6)..(6): n is a, c, g, or t
  misc_feature (24)..(24): n is a, c, g, or t
  misc_feature (52)..(53): n is a, c, g, or t
  misc_feature (57)..(57): n is a, c, g, or t
  misc_feature (83)..(83): n is a, c, g, or t
  misc_feature (105)..(105): n is a, c, g, or t
  misc_feature (108)..(108): n is a, c, g, or t
  misc_feature (129)..(129): n is a, c, g, or t
  misc_feature (142)..(142): n is a, c, g, or t
  misc_feature (154)..(154): n is a, c, g, or t
  misc_feature (165)..(165): n is a, c, g, or t
  misc_feature (185)..(185): n is a, c, g, or t
  misc_feature (242)..(242): n is a, c, g, or t
  misc_feature (272)..(272): n is a, c, g, or t
  misc_feature (274)..(274): n is a, c, g, or t
  misc_feature (290)..(290): n is a, c, g, or t
  misc_feature (292)..(292): n is a, c, g, or t
  misc_feature (303)..(303): n is a, c, g, or t
  misc_feature (316)..(317): n is a, c, g, or t
  misc_feature (432)..(432): n is a, c, g, or t
  misc_feature (471)..(471): n is a, c, g, or t
  misc_feature (477)..(477): n is a, c, g, or t
  misc_feature (878)..(878): n is a, c, g, or t
gaaatntaggaagattaggtgccnaaatacccagcacagtacttgtatattnntagnaccatacagaagtaaaatcccagganctatgaacactagaccttatgnggnttattccttcaatcatttcanacattgaaagtanggcctacatggntatttgcctgntcactttatgtttacatctnccacattcataccaatatacgtcaggtttgcttaaccattgattttttttttttttnaccaagtcttacagtgattattttacgtgntnccatgtatctcacttngngctgtattaanaaaacctccattnngaaaatctacgttgtacagaagcacatgtctttaatgtcttcagacaaaaaagccttacattaatttaatgtttgcactctgaggtgcaacttaacagggagggcctgagaaaangaatgggagggggctattaattatttttagcaaaatgtngccttngtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataatttngtcagtgttcaccagcttgtaaaaacttagtgcgagagctgaaacatctaaataaataatgacatgcatttatcatcaaaaaaaaaaaaaaaaaacaaaaaaaaaaaaaaaaaaaaaaaaaaaaaaactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450398 - DNA, 4576 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatg

SEQ ID NO: 450399 - DNA, 5931 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaagatccgggcgggcgtggggtaggccggacagccaggcacgggtggtaacgatctggttccagagcttctcggagctccggggtgggcgcgggacagccactgggtgcagctacactcttgtgctcgacggccgggacccgagcctcagacaaaatggcctcggcgcccgcgcctgactgaaggcgcggcgcgaacccgtgattgcggcgcggagagggggcgcagcgggcgtgctcgggcgcacacagccgcgtgcgcggggcggcggccctctggggcattccgcgagctgcacccctgcccgggccagagtggggttctgctagcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450400 - DNA, 4879 bp, Homo sapiens
cgggcatggcaggctccgcggcgtcccggggcctctttgttcggccggaggagagtggctgcactgggagcgggagacgtggcccggggtggggcgagggctgcgcgtgtcactgcggagccggatacggggagggcgcggcggtggcgggttcgcctccagatccgggcgggcgtggggtaggccggacagccaggcacgggtggtaacgatctggttccagagcttctcggagctccggggtgggcgcgggacagccactgggtgcagctacactcttgtgctcgacggccgggacccgagcctcagacaaaatggcctcggcgcccgcgcctgactgaaggcgcggcgcgaacccgtgattgcggcgcggagagggggcgcagcgggcgtgctcgggcgcacacagccgcgtgcgcggggcggcggccctctggggcattccgcgagctgcacccctgcccgggccagagtggggttctgctagcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450401 - DNA, 4447 bp, Homo sapiens
  misc_feature (38)..(38): n is a, c, g, or t
ggctgttctagaggatcccggtcaatttctacaccaantgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450402 - DNA, 5672 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450403 - DNA, 3583 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcat

SEQ ID NO: 450404 - DNA, 3553 bp, Homo sapiens
  misc_feature (6)..(6): n is a, c, g, or t
  misc_feature (24)..(24): n is a, c, g, or t
gaaatntaggaagattaggtgccnaaatacccagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450405 - DNA, 2712 bp, Homo sapiens
gcggaaccccagatttctccttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450406 - DNA, 3119 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttggtagaccactgacttgcgcctccttcttaccagttctaacgcgttatctacgtgtttcagtgttcccacttgtgccggttagaaagcctcctttgaaattcttgtacaaggccgttctcggtctcgacaacggcccatataaggtggcccggggacgcagagggggcagacagggggggatatatccaggctctttgctctgtgccataaccagaaggtccatcacgcatctcacatacttgtctcagtctatatatgtttttttctgtctccgc

SEQ ID NO: 450407 - DNA, 1978 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggtaagatttgatatgttttagtagcttaaattgattgcaatataatagtgggacttatagctaacaaaataaaaactactttggaaaaaatga

SEQ ID NO: 450408 - DNA, 971 bp, Homo sapiens
  misc_feature (6)..(6): n is a, c, g, or t
  misc_feature (24)..(24): n is a, c, g, or t
  misc_feature (52)..(53): n is a, c, g, or t
  misc_feature (57)..(57): n is a, c, g, or t
  misc_feature (83)..(83): n is a, c, g, or t
  misc_feature (105)..(105): n is a, c, g, or t
  misc_feature (108)..(108): n is a, c, g, or t
  misc_feature (129)..(129): n is a, c, g, or t
  misc_feature (142)..(142): n is a, c, g, or t
  misc_feature (154)..(154): n is a, c, g, or t
  misc_feature (165)..(165): n is a, c, g, or t
  misc_feature (185)..(185): n is a, c, g, or t
  misc_feature (242)..(242): n is a, c, g, or t
  misc_feature (272)..(272): n is a, c, g, or t
  misc_feature (274)..(274): n is a, c, g, or t
  misc_feature (290)..(290): n is a, c, g, or t
  misc_feature (292)..(292): n is a, c, g, or t
  misc_feature (303)..(303): n is a, c, g, or t
  misc_feature (316)..(317): n is a, c, g, or t
  misc_feature (432)..(432): n is a, c, g, or t
  misc_feature (471)..(471): n is a, c, g, or t
  misc_feature (477)..(477): n is a, c, g, or t
gaaatntaggaagattaggtgccnaaatacccagcacagtacttgtatattnntagnaccatacagaagtaaaatcccagganctatgaacactagaccttatgnggnttattccttcaatcatttcanacattgaaagtanggcctacatggntatttgcctgntcactttatgtttacatctnccacattcataccaatatacgtcaggtttgcttaaccattgattttttttttttttnaccaagtcttacagtgattattttacgtgntnccatgtatctcacttngngctgtattaanaaaacctccattnngaaaatctacgttgtacagaagcacatgtctttaatgtcttcagacaaaaaagccttacattaatttaatgtttgcactctgaggtgcaacttaacagggagggcctgagaaaangaatgggagggggctattaattatttttagcaaaatgtngccttngtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttctcccacagaactataaccacacatccccagacagtataaatatatggttatagttctgtgggagaaataattttgtcagtgttcaccagcttgtaaaaacttagtgcgagagctgaaacatctaaataaataatgacatgcatttatcatcat

SEQ ID NO: 450409 - DNA, 339 bp, Homo sapiens
atgcagtacaattcataagacagtaagtaatggattctcttttcatttgtactctctttcatttccttgttgagtgtcagtgagtttaatagtctaatagcccatttaatcattatgattattttttgagatagtattaaaaccaggaaatcaagatcttacattcttttttgcatttcatgcagttgctcatattactaagattctaatccaacaagagtttttgaattattgttttgctttaaatacttgattgaatatgttggttattttgtatttttattgaggtataattaagatacatttaaagatacaataaaatgcacaggtctccaaagg

SEQ ID NO: 450410 - DNA, 613 bp, Homo sapiens
aatatctatttaagtcataaatagacctcaaaaagctaaaaacaaatattatattattgtgcagaatcttaatttctaaataaaggtgaaaagctaagcaaggatttgaagttgtgaaacatttttgtaaagattgagcatttagtcacatttggtagacaacagggtttaataagatttgattaaacattaaaatgagaatgcttttgaaaacatttccatgttagaaatttagaattattactacagtgtttatattaatgatctaaaatgtttaaatattcttctgacttaggattggccttttgatgatggtgcaccaccatccaaccagattgttgatgactggttaagtcttgtgaaaattaagtttcgtgaagaacctggttgttgtattgctgttcattgcgttgcaggccttgggaggtaaatgaatttatcaatttgattctaggtaaaaatctattgataatgaaaatacagaaacttgaaaaattcttataattttttaatataaagtcaacatttgtcataggtattacttaaataggaagggtggtagataatacttctgagttggggaatgtttggagaaataaatttacaaagatct

SEQ ID NO: 450411 - DNA, 5727 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450412 - DNA, 6047 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgacaacaataaacaaacagaaaaaaaaaacaacccttggtgggggccgcgcctcggggcctcccggaagacaaggtttctaagacacctattgcggtaggggggcgccgcggtggcccaaagtgtaggtacaaggggacacacagtggggcgcaaagaggctggatccccctagaggagaaatcccggggggtccacgagaaaagagggcgagggagattcccccacgcatacaaaaaaacgcgccgggggcgggaaaccccggaggcggctcctggagaacaaacctcccagaagtggggaggtctcaggaggggaataaaaaccgggggactatttagaccaacacggggaggccccaagagagacgtccgggaagtcaagattatgagcccccgccacgggggga

SEQ ID NO: 450413 - DNA, 5673 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450414 - DNA, 5709 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccacaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450415 - DNA, 5673 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatattttttttttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450416 - DNA, 4724 bp, Homo sapiens
ttgtctggtatccttatgcagaatgaactgaaataatcatcaatctgaaaagctactcttaaacagagacttgcttcaacaccaggaagaacatgaaagggtgactcataattcccagcagcagtgccagttcatgtgctgggattctgaccacaagcctaacaatcaggtcagggagtcagatttctgttggatttagaaaagcatctatgtgtttatgaaagaaacccactggatttttaatagttctgcagctcttggaggctctacatctaccctttctccccagccaagagcatggctatgggagaaggaaggcaggcagcaggcagcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450417 - DNA, 5668 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacattcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttaaaatgattttatt

SEQ ID NO: 450418 - DNA, 3726 bp, Homo sapiens
  misc_feature (3629)..(3630): n is a, c, g, or t
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcatccaaaaaaaacaaaaattaaaattttttatttaaatatattttttnntatttaataaattttttaatattttttttattaattattaataaaattaaaaaaaatatatatattctttgtgggggggcgccggccccaaatccc

SEQ ID NO: 450419 - DNA, 2967 bp, Homo sapiens
taaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttccgacagtgtaattagagtcaaaacggtatattacgacgtcaagttaacgagtacatatgccacaagataaactatatgacggatcggcttacgcaccagagagattctgataattatatttatcaacaatattacgaggtgatgtgtgtgacgtgtttgccatgtatgtcactattctgactgtacgtatgaataaacatcatgttgcgat

SEQ ID NO: 450420 - DNA, 1198 bp, Homo sapiens
gccgcgccgtctcctgtttgtttcgccgacacgcctcctcctcatctctctactcgtcccctctcctcgctccttcccgtgccctgctccgccgctgtcccgcgccctcgcgccggcgcgcctgctgctgtcccgccgtctccccgtcgcccccgcctcccctctgtcgcgcgtcgtgtgcttgcctcccttgtcgtccgccgctccgcctcctcttcttggcctctctggcctcctccccctctgaccgctcgcccctctcccgcttgcgcgcacctcgtcgccccggtcggcgtccgcttgtcgctctcgttgtttcgtgtttcgtcttgctgtttcttcctgtttttcgctcgcttgtgtcctgttctcttcgcatcttcggtccgcctctgtccgctctcttccgtgtgtttgctctttgtcgcgttgtcctttgtcgtgcgttgtttccatgctctgtgttgcgcttgctttcttcctttcctgttctccctcttgctgtcgtgtttccttctccgttgctcgccccccgctcctctccttccccctccctgtcgttgtctcgcgtgctctggtgcccctcctctcgttctcgctcgtcttctttctgcgccgccgcgcgcccgctctccctgcggcgtgttgctgtcgttctctgttctttttccctcctcttctgtgttgctgcgcctccccagtctcttcttttgtcctctcctgttcgtcctcctccgtggtctttgcgcctgtccgcctcgcccgctttgttggctgtgctctggctcgtcctctccctctatccgccgtgtgttctgttttgtgcctctgccccccctgccggcggcctccgtgccgccccccccctccctctctttttctttctgcttgtgtctttctttctctcctctctctctctttctctcctcttcttctttttttttttttttttttttttttttttttctctttttttttttttttttttttttttttttttttttttttttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagaga

SEQ ID NO: 450421 - DNA, 314 bp, Homo sapiens
cttattcaaagtccttcgttctcattcccacagtgctctaagccatgaagcttttcatccatctttcaatttgtaggccagcaaacgaattacaagtgatgtcttttcttccttgaattacctgcttttattccttgactccctgtccagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagaga

SEQ ID NO: 450422 - DNA, 2570 bp, Homo sapiens
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagagacattttgtgtgttctgtcgttttatttcagcccagtcccctctttctgacttgtgatctcatagagcaacagtatctcctggtctgtttttagttctgtcactcgatgtcatttatctctttataataggatggccccggggccttttttgaacagtagtaatgacttcatttgccaccgtgctaaatgatacacaacctattacattcaccagtccttcattataccattgacctgaggctagcaagagattttgtctgactgtaaagttgaaagtcaaaagcttatttctggtcccactcttagcagtgtattagatgtggaaataaaagtcattttgggtagctgctatgaaactttctgagcagattcttggctgcaccgatgtatgacagaatttatggagaggcctatggcaatatgagcaacttgaaaactcctaaggaagtgcaggtagctaacagcttggtgtggtgtgtgtgggtaacaatccacatcaaaagtgagctttacattgacttggattgttagacatcagtgggttattctgttgtttttataaaaggtttatactgtatcaatggaatgagtcatttatgatgaatttgcaataagcaaagcattaaaaatgaaatattcagtgtccattttgaggtagaattggtgtcaacacagaacgttcttcctctcaaggtgtaggaatcaatagtatggtatttaaaaaaaaaaa

SEQ ID NO: 450423 - DNA, 2205 bp, Homo sapiens
  misc_feature (1871)..(1871): n is a, c, g, or t
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagagaaaaaaaaaaaaaaaaaaaaaaaaaaaaaaanaaaaaaaaaaaaaaaaaaaaaaagaaaaaaaacaaaaaaagaaaaaaagaaaaaaaaaaaaaaaaaagagagaccaagaacaaaaaaagaataaacaaagagaaaccacaaactataagaagaaacacacaacaaaggagaaggagacaaagaagaaggaggacagccacaaagaagagaggagcacacataagaatgaagaacaaagcaaaggagaaaaaagaaagagacaacgcaagtcgacaacaagcaccaaacaatatacgaagagacaaacagaagacagaacgaaacaagacgagacaagaagggagacagagtagaacctacaaca

SEQ ID NO: 450424 - DNA, 1903 bp, Homo sapiens
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagggtggagaatgtttatcgctcatgtcatgacaagggataagtgacactgacaactttgttcagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagaga

SEQ ID NO: 450425 - DNA, 1746 bp, Homo sapiens
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagaga

SEQ ID NO: 450426 - DNA, 1587 bp, Homo sapiens
  misc_feature (1495)..(1495): n is a, c, g, or t
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcatgatgggattcttaagtttcttttttatattattttattaaaagaggaagttttngaggaaggttttgaagagaagtgtgagagaggaagatagagggcaaaaggggaatagggggggaggagaaaaagagagaggggaagcacaaa

SEQ ID NO: 450427 - DNA, 1788 bp, Homo sapiens
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagaga

SEQ ID NO: 450428 - DNA, 1352 bp, Homo sapiens
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattcaggcccgtaccaagactttgtcatgcttgccaggctagactcgtagaggatcgcttataacgtttagatatgtc

SEQ ID NO: 450429 - DNA, 1280 bp, Homo sapiens
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagaggtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagaga

SEQ ID NO: 450430 - DNA, 674 bp, Homo sapiens
cttattcaaagtccttcgttctcattcccacagtgctctaagccatgaagcttttcatccatctttcaatttgtaggccagcaaacgaattacaagtgatgtcttttcttccttgaattacctgcttttattccttgactccctgtccaggtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagaga

SEQ ID NO: 450431 - DNA, 1126 bp, Homo sapiens
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaattgaactctatggcagtgttaaaaagattagtattactgtaccaaaactttcctttgacaatgtaagcagtgtcagcttgcgatgaaaatgtaggctatttatacttttaggctaaaaggatcagaaaattcagccagactgctagtcgagttcattgaaacttttaatttgatttttgctgttctgaaggtacatagccagatttcattgaaacttctgtggagaaggtttactgtgtagaaattgaa

SEQ ID NO: 450432 - DNA, 1110 bp, Homo sapiens
  misc_feature (787)..(787): n is a, c, g, or t
  misc_feature (799)..(799): n is a, c, g, or t
  misc_feature (803)..(803): n is a, c, g, or t
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttgggcgaagagtgattggcatatncccgggcccatnattnggcaggggcaagaagatcccctgggaaagatgtctcatctggcagtgcacggggctttggttaatgtcaactaaccagatgccttggtaattgcccggtgttgggtgacaatctgcaaccggggcttcaccctcggacgtcgccagtccgacagccccaggcatagtaacggggcccgccggcagcccggaggatgggtcctctgagtccttctcagacccgacccactcacacaagccaccaccgccacaccacccacccaccacaccaccatccaccagccctcaacccgctaagctcacggact

SEQ ID NO: 450433 - DNA, 401 bp, Homo sapiens
ttggtgttgctggaccttcagagttatgatggtgatgcgcaaggcaaagaagagatcgacagtgtcggtttttcactttcatttactcagtgtttaaggatcatagtatctgcttagcttagtgttaaaataatgttctcttcattgcttactttccagttaattttaaactttcctccctccacataagtgattttagaatagaagtagttgtttagttgtttttaggaacctgggtgtcagcgttcccttttaactgccttagtatgagtaatcttattttccactggagggaatagaaaacctttaaccaggattttatagctgcagtaccctttagccttcctcttccgtgttactttgttgctaacttacgctaaggttaggtcagcaacatgaag

SEQ ID NO: 450434 - DNA, 362 bp, Homo sapiens
ttgaatatgacatagatgaagtggtatatgacgaagattcaccttatcaaaatataaaaattctacactcgaagcagtttggaaatattctcatccttagtggggatgttagtaagtattccatccctgccccgatcacgtaacaaagtggtgatgtgttgaatgatggtgttttcctgacaattactactgtcgtggatttgtttgagtttgtttttgacactgctggtttttgagatgcacatttatgtcatattaacctgtggattgtctgggctttcacataaactttgtcttgacattgcttccttagtgatgagtatttggattgtatttcaaaagaaaatgcatttgcatattta

SEQ ID NO: 450435 - DNA, 155 bp, Homo sapiens
tggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaatta

SEQ ID NO: 450436 - DNA, 1840 bp, Homo sapiens
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagaga

SEQ ID NO: 450437 - DNA, 2184 bp, Homo sapiens
  misc_feature (1850)..(1850): n is a, c, g, or t
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagagaaaaaaaaaanaaaaaaaaaaaaaaaaaaaaaaagaaaaaaaacaaaaaaagaaaaaaagaaaaaaaaaaaaaaaaaagagagaccaagaacaaaaaaagaataaacaaagagaaaccacaaactataagaagaaacacacaacaaaggagaaggagacaaagaagaaggaggacagccacaaagaagagaggagcacacataagaatgaagaacaaagcaaaggagaaaaaagaaagagacaacgcaagtcgacaacaagcaccaaacaatatacgaagagacaaacagaagacagaacgaaacaagacgagacaagaagggagacagagtagaacctacaaca

SEQ ID NO: 450438 - DNA, 1851 bp, Homo sapiens
gggcggaggccgcgctcctgctggctccgcgctccgtcccggccgcagctcggggcctgcaggggcagtcccgggtgcccgccggccgcgccgcccttccgggccctggccgtccacccgcgctcccacgcgggctcgccgccttcgcgctcccgctcggggagtccccgggctgccgggcgcgggcggaccccccatgggacgagggttgcagggactgcggcggagcgaggcgtgacccgcgcggcgagcccgggctgggggcgtgcgccgagcggggctgcccgcgcgaccttttcctgttcttgcaggcggctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagaga

SEQ ID NO: 450439 - DNA, 1660 bp, Homo sapiens
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttgtggggcgcattcttatgcaaaatgggaattggggctaaactggtttgtttgttgctcttcagaattgccgtttgtgtatgctgtgccaaagcagcttctccaccccctggaggag

SEQ ID NO: 450440 - DNA, 1373 bp, Homo sapiens
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattttctcttacattctggagagtcagtagttcgaatgcgcctgtagtggctaataagta

SEQ ID NO: 450441 - DNA, 1154 bp, Homo sapiens
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgtttaggttacagccatttaggttacagccatttaggaacagccatttagtagggatcctca

SEQ ID NO: 450442 - DNA, 1044 bp, Homo sapiens
acgtttccaccattagcgaggcctcacacccggcgctccaagttcggggctggaggcgtcccggcttcctccctcccggaggcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaattgaacttcaatttctacacaaagaaagcaaacgaacaatttcttttacatgaagtatgctgtgttgaaagttcttttcagtggcatttcatgagtttgccttttctgaaccctggaaacagacattactcatctgagacatgattattctagtgtagaaattgacc

SEQ ID NO: 450443 - DNA, 2011 bp, Homo sapiens
gccacagcccagctgttccctccgcggattctccggggctggttcatcacctccgaatattcctgtgacaggagacgcttgcaaaacccgcctccagcctccagcagcaaataaatagaaggcttgcagcccagaaggagccagaagaagtttctaggcgcgcgtgccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagaccccttccgggactctcccctctcctctcgcctgctggatgatggctttggcatggaccccttcccagacgacttgacagcctcttggcccgactgggctctgcctcgtctctcctccgcctggccaggcaccctaaggtcgggcatggtgccccggggccccactgccaccgccaggtttggggtgcctgccgagggcaggacccccccacccttccctggggagccctggaaagtgtgtgtgaatgtgcacagcttcaagccagaggagttgatggtgaagaccaaagatggatacgtggaggtgtctggcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttaaaaaa

SEQ ID NO: 450444 - DNA, 1065 bp, Homo sapiens
  misc_feature (757)..(757): n is a, c, g, or t
  misc_feature (761)..(761): n is a, c, g, or t
  misc_feature (767)..(767): n is a, c, g, or t
  misc_feature (770)..(770): n is a, c, g, or t
  misc_feature (774)..(774): n is a, c, g, or t
  misc_feature (781)..(781): n is a, c, g, or t
  misc_feature (794)..(794): n is a, c, g, or t
  misc_feature (796)..(798): n is a, c, g, or t
  misc_feature (819)..(819): n is a, c, g, or t
  misc_feature (822)..(822): n is a, c, g, or t
  misc_feature (828)..(828): n is a, c, g, or t
  misc_feature (844)..(844): n is a, c, g, or t
  misc_feature (898)..(898): n is a, c, g, or t
  misc_feature (901)..(901): n is a, c, g, or t
  misc_feature (909)..(909): n is a, c, g, or t
  misc_feature (913)..(914): n is a, c, g, or t
  misc_feature (919)..(919): n is a, c, g, or t
  misc_feature (928)..(928): n is a, c, g, or t
  misc_feature (930)..(930): n is a, c, g, or t
  misc_feature (937)..(937): n is a, c, g, or t
  misc_feature (950)..(950): n is a, c, g, or t
  misc_feature (954)..(954): n is a, c, g, or t
  misc_feature (960)..(960): n is a, c, g, or t
  misc_feature (970)..(970): n is a, c, g, or t
  misc_feature (973)..(973): n is a, c, g, or t
  misc_feature (978)..(978): n is a, c, g, or t
  misc_feature (982)..(982): n is a, c, g, or t
  misc_feature (988)..(988): n is a, c, g, or t
  misc_feature (990)..(990): n is a, c, g, or t
  misc_feature (997)..(997): n is a, c, g, or t
  misc_feature (1003)..(1003): n is a, c, g, or t
  misc_feature (1005)..(1005): n is a, c, g, or t
  misc_feature (1060)..(1060): n is a, c, g, or t
gccacagcccagctgttccctccgcggattctccggggctggttcatcacctccgaatattcctgtgacaggagacgcttgcaaaacccgcctccagcctccagcagcaaataaatagaaggcttgcagcccagaaggagccagaagaagtttctaggcgcgcgtgccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagaccccttccgggactctcccctctcctctcgcctgctggatgatggctttggcatggaccccttcccagacgacttgacagcctcttggcccgactgggctctgcctcgtctctcctccgcctggccaggcaccctaaggtcgggcatggtgccccccggggggcccccacattgccnaccngcctangtntttntggggtncctttgcctgaangnnngagggaccccccccccacccnttncccttnggggggagccccttgngaaaagttgtggtgttgaaatggtgccacagctttctaagcccagcagggagtntgnatgggtgnaagnnccaanagatgggananagtgggnaggtggtctggcncaanatatgnaagaagaaanaanccaanaaangtggcncnttgtttncttaananattctcaaaaaaaaaaacccaacattccctgccgaaaggtggggtccttgtgccnagttt

SEQ ID NO: 450445 - DNA, 1917 bp, Homo sapiens
gccacagcccagctgttccctccgcggattctccggggctggttcatcacctccgaatattcctgtgacaggagacgcttgcaaaacccgcctccagcctccagcagcaaataaatagaaggcttgcagcccagaaggagccagaagaagtttctaggcgcgcgtgccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagaccccttccgggactctcccctctcctctcgcctgctggatgatggctttggcatggaccccttcccagacgacttgacagcctcttggcccgactgggctctgcctcgtctctcctccgcctggccaggcaccctaaggtcgggcatggtgccccggggccccactgccaccgccaggtttggggtgcctgccgagggcaggacccccccacccttccctggggagccctggaaagtgtgtgtgaatgtgcacagcttcaagccagaggagttgatggtgaagaccaaagatggatacgtggaggtgtctggcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttaaaaaa

SEQ ID NO: 450446 - DNA, 1217 bp, Homo sapiens
gccacagcccagctgttccctccgcggattctccggggctggttcatcacctccgaatattcctgtgacaggagacgcttgcaaaacccgcctccagcctccagcagcaaataaatagaaggcttgcagcccagaaggagccagaagaagtttctaggcgcgcgtgccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagaccccttccgggactctcccctctcctctcgcctgctggatgatggctttggcatggaccccttcccagacgacttgacagcctcttggcccgactgggctctgcctcgtctctcctccgcctggccaggcaccctaaggtcgggcatggtgccccggggccccactgccaccgccaggtttggggtgcctgccgagggcaggacccccccacccttccctggggagccctggaaagtgtgtgtgaatgtgcacagcttcaagccagaggagttgatggtgaagaccaaagatggatacgtggaggtgtctggtaagtcaggggcaggagggagagagaatggggaggccgggatgtagccctcagccctgggaatagccagagaaagtttcctgggagctgacgttgggacagtgtgacacaggtgacctcagggctcaggaatgcagcctgcaaagttatctttacggaaaacttctctcccggctcccagcagagatcttaacctgcctgactcagctattggggcctctgggtgctcatcaatcatggtacagacaggaaaatagaaaccatgttggatattttgacagagggcatttaatataaagaataggttaagcagatatcaaagaatt

SEQ ID NO: 450447 - DNA, 1248 bp, Homo sapiens
caagggttacttttctctggggacctcccccatcacccaggttccctggaaagtgtgtgtgaatgtgcacagcttcaagccagaggagttgatggtgaagaccaaagatggatacgtggaggtgtctggcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttaaaaaa

SEQ ID NO: 450448 - DNA, 1214 bp, Homo sapiens
atcgatctagaggactccccattgtaagatgtgcacagcttcaagccagaggagttgatggtgaagaccaaagatggatacgtggaggtgtctggcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttaaaaaa

SEQ ID NO: 450449 - DNA, 1345 bp, Homo sapiens
ttccatcaattatcttatttcaccttcatagccagccttggaagtggacttaggtgggtctgtatggcagacaaggtccttgaggcttagataactagagtctctagggtaggcctaagtcacacagcaaggcaggtccagggccaggatttgaacccaagcctcagtcctgaaggatgcccaaggaacatagatgctgacacgccacacttttcttccttccaggcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttaaaaaa

SEQ ID NO: 450450 - DNA, 1196 bp, Homo sapiens
gcagaggtggtcagggaaggcaattcctggaaagaattttggagaaaataatagaagaaagccagagctccaataagcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttaaaaaa

SEQ ID NO: 450451 - DNA, 1841 bp, Homo sapiens
  misc_feature (43)..(43): n is a, c, g, or t
gacccaatgcgcgccccgcttgattacgttaggttccatcccntgattgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagaccccttccgggactctcccctctcctctcgcctgctggatgatggctttggcatggaccccttcccagacgacttgacagcctcttggcccgactgggctctgcctcgtctctcctccgcctggccaggcaccctaaggtcgggcatggtgccccggggccccactgccaccgccaggtttggggtgcctgccgagggcaggacccccccacccttccctggggagccctggaaagtgtgtgtgaatgtgcacagcttcaagccagaggagttgatggtgaagaccaaagatggatacgtggaggtgtctggcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttaaaaaa

SEQ ID NO: 450452 - DNA, 1943 bp, Homo sapiens
gccacagcccagctgttccctccgcggattctccggggctggttcatcacctccgaatattcctgtgacaggagacgcttgcaaaacccgcctccagcctccagcagcaaataaatagaaggcttgcagcccagaaggagccagaagaagtttctaggcgcgcgtgccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagaccccttccgggactctcccctctcctctcgcctgctggatgatggctttggcatggaccccttcccagacgacttgacagcctcttggcccgactgggctctgcctcgtctctcctccgcctgccgagggcaggacccccccacccttccctggggagccctggaaagtgtgtgtgaatgtgcacagcttcaagccagaggagttgatggtgaagaccaaagatggatacgtggaggtgtctggcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttaaaaaa

SEQ ID NO: 450453 - DNA, 1159 bp, Homo sapiens
  misc_feature (24)..(24): n is a, c, g, or t
aactagcggcactgactctcttanctaccacggctaaccgcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttaaaaaa

SEQ ID NO: 450454 - DNA, 1151 bp, Homo sapiens
ctgccgctactactaccggcgggcgtgtctggcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttaaaaaa

SEQ ID NO: 450455 - DNA, 410 bp, Homo sapiens
gaaacactctgggtctctgcttgatcagtgtcccctctaaactgcacctcactacagtagggatggcataagatacttctttacacagcatctttttgttcccacctcacccccagagctgtaataggtagagccagccaaatgtcaaagggatgatttgtcttgtcaccactagtttcccttttctctgccttgtatgtaacaggaatattctttagttcctccttatgttctaaagcacctccccaacctaaaaatagaagaggagttgtggggtcatttacactttagtgtgaatttgcccttgtgactttgccaaggctgttgtgcctaaccctttcaatctaacagcagaatgagagtctctgggactatccggggtccttccctggagaaggaatgaactggga

SEQ ID NO: 450456 - DNA, 1451 bp, Homo sapiens
tccagccaaggaaaaaattcttgattggtgtatttgttttcctgagacttctataactaattgctacaagcatgctagcttaaattaacagatttattctgttggttcccaaagtcactaggaattgagtgtggataaactcacagggctggcctaattgtattttctttgaaggataaaaagcttctctaaaaggttcatattctttgactcagcaattccacttacaggaattttttaagagcaattacacaatgatagtctttatctcattgaacactcactgcaatttcgatggtctcattcgttcattgagcatatttattaggtgtgtcttccaagggtcatcccattcgggacttaatacagctggaaacagtggtggcccgcccccaccccagtggagctcaccttccagtaggtctaaactggtttgattgagttccatggaaaacaacaaagtggggtaaggggaaaagtagtggggagctgagggggtcagcatgacatggaagcagaaatcaagagacaaggctttgtggggtgtgggtgtgggtccaagtgccaagggccagggagctttgtagagtgtgtggttatgtttctcagtgtttcctcatagttggttaactaatacatttgttcatgcaattaagccatcttttcattttctaacatttttaaaaatacatatattttttagagatgggggtctcgctttgttgcctaggctggtctccagctcctcagctcaagggatcctcctgccttggcctcccaaagtgctgggattataggtgtgagccaccaggcccagccaattaagctgcattttaaaacaaccaagacagaccttaaaccttggagctgctgacccaagctcatcctcacccctcttccccagagtctaccccagggaggaacagggactggccagtcaggtgagggttctctagctttggcctcaagctctggtgtgacatgggtgctgttttcacctgtggagggaggtatgtcgcctggaataaaggctcgccagagggcagggccttgtgcggcttttctcagcacctagatagtgcctggcaccatgttctcagcacctagatagtgcctggcacacatgagtctctgggatacagtggagtgagtgcagtgaacagatggctgaggaggctgtgtagatgggaaaggccttcgccagctcgcggggatgagcttaggccgggggactgagttctgtgtcctggctttttgtttgttttttaagagcctggagtcacatcctgccctttttttttttttaagggaaaaatggtggttttattcatttgtacttaaaccagccaaagtagtactgatgtgattatgattcagcaaatacaagatctctttccacaaatattagcataacaatcaaaatagggactatagtaaaacagccaaaaagg

SEQ ID NO: 450457 - DNA, 732 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggtgaggactcccgagcgggccaagggg

SEQ ID NO: 450458 - DNA, 355 bp, Homo sapiens
ggacgcggctgttctcctacccatggaacctctgggaaccatccagaaaaccagcaaggacaagacagctccccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttt

SEQ ID NO: 450459 - DNA, 1902 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaattttttttttttttttttttttttttggaaggggtttttgccttttgcccccgggggggggggggggggcaccccccggctcctgggaccctttgcccccggggttgggggaatttttccggccccaccccccgggttttgggggttatggggcc

SEQ ID NO: 450460 - DNA, 1746 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttt

SEQ ID NO: 450461 - DNA, 1705 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaacctatctgtgctgcacaactcttggttctcacagagatatactaggttctttggtccattgttgagtcctgggacacttggtcgcagt

SEQ ID NO: 450462 - DNA, 2496 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggagggggtgagtacggatcgggcgtgcgggccggccggctaactgcccgggaccccgggtcggttttccaccctgctgcttctgggagtctcaggttgagatttaatttttttgtagtagttcagaaatttccagggaatgtggcttccaccctaaaactaaatgtttcattcttaggcagttatgggtgaggccaggagggggagttgatgcatgcatcgtgtgcactttatttcacgaagttaggaagcctttaaacacctttttttagtgttaaatttcgcttaatgtaaaagaaagattatatatgcatgctttttgaaaggtgtctgatactcaattatttaatgtatttaaaaggagcggtcccttctccaccccatcttagctctagtacaacttcccataaaccttcttttgcgtaatgtgcattagcaaggacatttttaaatcatcatgtttgttgccaacgaaacagccatagagctgaaatttgaagactgaaaccgccgagcgtttagtggctaatagcaaagtattgctgtttcagtttgttgtctcaaaccatcatcttgaagtgtgcatgctactaatatccattttatagacaaggcttctgagacagctggtttcagagcccatgatcttgctctgtctcccaacttggctgtcagtacagaccccagggctgggctctgtactgcgctcactcttgaccactttcccctctttctcacccagttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttt

SEQ ID NO: 450463 - DNA, 1856 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagatggtgactgctttttctggtcctctttcatcgtagctggtgcttcctcggggcctgccctggcccagaagaggcactcagaaaatatttgaccgcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttt

SEQ ID NO: 450464 - DNA, 1412 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttt

SEQ ID NO: 450465 - DNA, 1260 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagcacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttt

SEQ ID NO: 450466 - DNA, 1183 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccgctctaattgtttctttttgtctatctttgaatctttattccagagatccagttgtcattggtatccagggagccctcctcttcctcctcctcctcctgccgcgttgagatcaggcatgt

SEQ ID NO: 450467 - DNA, 1080 bp, Homo sapiens
ggacaactgtgccaggaatgtctccaaacaatggaaccaaaagaaacacagtaaaattctcctgtagaagaaaccaagagttgtgccagcaccccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttttttttcctccaggacttgtgtgttttgttctgcgcacacaccgccaactgttcccccacagtcagcagcaggttgggcctgaccattgggacttgattgtcaagtcactggaggtcttgacttttttatctcagttcatgttctcttccataattggaaaggacctttgtctgtttttcctcttgggtgccttccagaacgcatctcatgtccctggtgagggaattggtgagggcctgctgtgagctgctgtggctgcgatggtcacccagctgggcaaatcactggagtgacaatttgacctgtcacctgagaaggatggtccctcagactgctgggtagagggcctggggcaggctggagagagagaaagtgggcagagggtgaagggatcacaggggtcttggaaggtggcagtagtttggacgggggtggggagtatgtgggagaaaaaaacagactgaaggtagaatccttgggaacctttgaggagcggcacattctggcaggcacgttttctgtgagcctgaagttaggaagagacattctggaggtcaatttcctacatcctcttacaggcggagaccttgaagtggggccaggaaggaaggttggcaaaacctttgaccagaactgtccttcatttacagaaactgacccagaccacaacacaaaaggccagtaaaagtaagaaaaaaaaattt

SEQ ID NO: 450468 - DNA, 230 bp, Homo sapiens
atggtgactgctttttctggtcctctttcatcgtagctggtgcttcctcggggcctgccctggcccagaagaggcactcagaaaatatttgaccggtgaaggaaggaacagacagatgctctggagggcatgggtgcccgtgggttggagcaggaagaaagaagctggttgtgggaaagtgtgttgggtgtggttttcttgactttttcttctttctattcctgcctcag

SEQ ID NO: 450469 - DNA, 532 bp, Homo sapiens
accactgcatgccagcctgggcgacagagcgagacttatcaaaaaaaaaaaaaaaaatcgaaattaaagctgttgtgtgctgtcctgacagcaggtcactaggaattgagtgtggataaactcacagggctggcctaattgtattttctttgaaggataaaaagcttctctaaaaggttcatattctttgactcagcaattccacttacaggaattttttaagagcaattacacaatgatagtctttatctcattgaacactcactgcaatttcgatggtctcattcgttcattgagcatatttattaggtgtgtcttccaagggtcatcccattcgggacttaatacagctggaaacagtggtggcccgcccccaccccagtggagctcaccttccagtaggtctaaactggtttgattgagttccatggaaaacaacaaagtggggtaaggggaaaagtagtggggagctgagggggtcagcatgacatggaagcagaaatcaagagacaaggctttgtggggtgtgggt

SEQ ID NO: 450470 - DNA, 357 bp, Homo sapiens
ccattcgggacttaatacagctggaaacagtggtggcccgcccccaccccagtggagctcaccttccagtaggtctaaactggtttgattgagttccatggaaaacaacaaagtggggtaaggggaaaagtagtggggagctgagggggtcagcatgacatggaagcagaaatcaagagacaaggctttgtggggtgtgggtgtgggtccaagtgccaagggccagggagctttgtagagtgtgtggttatgtttctcagtgtttcctcatagttggttaactaatacatttgttcatgcaattaagccatcttttcattttctaacatttttaaaaatacatatattttttagaga

SEQ ID NO: 450471 - DNA, 462 bp, Homo sapiens
tctctcaacgccccctccctcccaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagg

SEQ ID NO: 450472 - DNA, 1761 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttt

SEQ ID NO: 450473 - DNA, 2465 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttttttttcctccaggacttgtgtgttttgttctgcgcacacaccgccaactgttcccccacagtcagcagcaggttgggcctgaccattgggacttgattgtcaagtcactggaggtcttgacttttttatctcagttcatgttctcttccataattggaaaggacctttgtctgtttttcctcttgggtgccttccagaacgcatctcatgtccctggtgagggaattggtgagggcctgctgtgagctgctgtggctgcgatggtcacccagctgggcaaatcactggagtgacaatttgacctgtcacctgagaaggatggtccctcagactgctgggtagagggcctggggcaggctggagagagagaaagtgggcagagggtgaagggatcacaggggtcttggaaggtggcagtagtttggacgggggtggggagtatgtgggagaaaaaaacagactgaaggtagaatccttgggaacctttgaggagcggcacattctggcaggcacgttttctgtgagcctgaagttaggaagagacattctggaggtcaatttcctacatcctcttacaggcggagaccttgaagtggggccaggaaggaaggttggcaaaacctttgaccagaactgtccttcatttacagaaactgacccagaccacaacacaaaaggccagtaaaagtaagaaaaaaaaattt

SEQ ID NO: 450474 - DNA, 1851 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttttttttttttttttttttatttttttttttttttatttttttattttatgggtatttgagggacaacaattttttttttttgggagggagg

SEQ ID NO: 450475 - DNA, 2425 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagaagacaaggctttgtggggtgtgggtgtgggtccaagtgccaagggccagggagctttgtagagtgtgtggttatgtttctcagtgtttcctcatagttggttaactaatacatttgttcatgcaattaagccatcttttcattttctaacatttttaaaaatacatatattttttagagatgggggtctcgctttgttgcctaggctggtctccagctcctcagctcaagggatcctcctgccttggcctcccaaagtgctgggattataggtgtgagccaccaggcccagccaattaagctgcattttaaaacaaccaagacagaccttaaaccttggagctgctgacccaagctcatcctcacccctcttccccagagtctaccccagggaggaacagggactggccagtcaggtgagggttctctagctttggcctcaagctctggtgtgacatgggtgctgttttcacctgtggagggaggtatgtcgcctggaataaaggctcgccagagggcagggccttgtgcggcttttctcagcacctagatagtgcctggcaccatgttctcagcacctagatagtgcctggcacacatgagtctctgggatacagtggagtgagtgcagtgaacagatggctgaggaggctgtgtagatgggaaaggccttcgccagctcgcggggatgagcttaggccgggggactgagttctgtgtcctggctttttgtttgttttttaagagcctggagtcacatcctgccctttttttttttttaagggaaaaatggtggttttattcatttgtacttaaaccagccaaagtagtactgatgtgattatgattcagcaaatacaagatctctttccacaaatattagcataacaatcaaaatagggactatagtaaaacagccaaaaagg

SEQ ID NO: 450476 - DNA, 1666 bp, Homo sapiens
ccaatttggaccagtaggcacaggatcacccttggcaccaggtgctccaacttcacctttagggccggcaacacctttgtctactcgagtgacccgtcggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttt

SEQ ID NO: 450477 - DNA, 1181 bp, Homo sapiens
ggccaggcatctacctggccccttccccccaactgccagggcttcttgagctgccggccctggggcattgagcctcaggaggccctcgggctcaaggggccctcctggtgcgctcttcttcccaggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttt

SEQ ID NO: 450478 - DNA, 1614 bp, Homo sapiens
ggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgacctcctacccccgtcatactattatactcatctccacaaaattctgaacctcatctcatcttctatgcttcacctatttacctaacttttctactaggttggtgcacagcaattgtggtaaaggtatattttagat

SEQ ID NO: 450479 - DNA, 6888 bp, Homo sapiens
ccaggagctgccttggcagtcacgccccttccttccgaggagctttctggctgcctaaactggtagaccccctgaattactcctccatctccgctctctttcgcctcctcttctcttagttctctccgcctccccctcaactaccaccacctccagtcagtctcgcctccggctatccgctgctccaccctctggcccggtatcctgcctgtccgctgccaccaaggagagcccggacggagcagcgaggaggggagcagccgggagttggggcttcccccctgcccatccctggccgctggcccgggaccgaagccacttgagcgagcagagagtcgtcaccttgtcttctttgccttcagggagctgctaagaaggacaaataagatagcagagtgaaagagcttttgtctccttagaaggaaggctgagaaactaaaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactacttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattagaacaaactttacttgatatgaaactcctattaacagtctttttttgaaataaaaagtagcttgagctttcttttaaaatcatgtatcttgattgttgatttaatgaaggatttccttttaatgctgcttttgagcttcaaggtaataggacagcaggaacctaaaatatctgccatcatctgccataggaaagatacccagagacccatcatgttctctttttgttgttacactgttgggtgggtataacaattggaaaatgaacaaactgattgattgtgcaaactactttttatgacaagcctaaaccctcataatgcggcagcttaaagtgtatacatatgcactaactttgatcaattatattctcatatctgttagctacacagtctcctattatctcaattgcttatgtgcatatggaatatgttacttaaaacgtgtgcattcttactgaaaatgttttcaaaggaaggtatcagctgtgggctaattgccaccaatttcagcctgccacgattcttggaaatatgtcttccaagtgccatccatcatcagtaggacaagtgtcgggagtttgtttatttttttccagtagcaacgatgggttacatggagccatgaaacctccttctggcctcccttgtgattaatggcatgtgtttgtaaaatggatagctggggttggcagatggctagagaagaatcgcctttggtttaaaatgtatgtggtcccctaatgattgtgaccccattctgtaatcaactgagctagttccaataaagttaagcaggtttaaatccactttgtgcctatcttttcactgacaataaagttagctattttaaaatgcagtaccgtgtggaaaatgctttggtgtttacccgacagaggctttatttgtgctgtatcagtgattactttcaattcagtatgcagtgaaattgcctttcaagggcagcgtgcagcagaatttgcatttgcttgaagtatggaatgtgattatagattataaagtattaagacaacaccacaggccgcatgctctaatcggtctctttatatactcaggcagcatatattaaaagctttgcatctttttatcttctggtttctagggataaaatgatggccacccaaagcagagaatttatcctttggttagcattttggaaggccccttgatattccttttgtacccttgttctgatgccaattcatcagtttt

SEQ ID NO: 450480 - DNA, 6464 bp, Homo sapiens
ccaggagctgccttggcagtcacgccccttccttccgaggagctttctggctgcctaaactggtagaccccctgaattactcctccatctccgctctctttcgcctcctcttctcttagttctctccgcctccccctcaactaccaccacctccagtcagtctcgcctccggctatccgctgctccaccctctggcccggtatcctgcctgtccgctgccaccaaggagagcccggacggagcagcgaggaggggagcagccgggagttggggcttcccccctgcccatccctggccgctggcccgggaccgaagccacttgagcgagcagagagtcgtcaccttgtcttctttgccttcagggagctgctaagaaggacaaataagatagcagagtgaaagagcttttgtctccttagaaggaaggctgagaaactaaaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactacttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattagaacaaactttacttgatatgaaactcctattaacagtctttttttgaaataaaaagtagcttgagctttcttttaaaatcatgtatcttgattgttgatttaatgaaggatttccttttaatgctgcttttgagcttcaaggtaataggacagcaggaacctaaaatatctgccatcatctgccataggaaagatacccagagacccatcatgttctctttttgttgttacactgttgggtgggtataacaattggaaaatgaacaaactgattgattgtgcaaactactttttatgacaagcctaaaccctcataatgcggcagcttaaagtgtatacatatgcactaactttgatcaattatattctcatatctgttagctacacagtctcctattatctcaattgcttatgtgcatatggaatatgttacttaaaacgtgtgcattcttactgaaaatgttttcaaaggaaggtatcagctgtgggctaattgccaccaatttcagcctgccacgattcttggaaatatgtcttccaagtgccatccatcatcagtaggacaagtgtcgggagtttgtttatttttttccagtagcaacgatgggttacatggagccatgaaacctccttctggcctcccttgtgattaatggcatgtgtttgtaaaatggatagctggggttggcagatggctagagaagaatcgcctttggtttaaaatgtatgtggtcccctaatgattgtgaccccattctgtaatcaactgagctagttccaataaagttaagcaggtttaaatcca

SEQ ID NO: 450481 - DNA, 6514 bp, Homo sapiens
ccaggagctgccttggcagtcacgccccttccttccgaggagctttctggctgcctaaactggtagaccccctgaattactcctccatctccgctctctttcgcctcctcttctcttagttctctccgcctccccctcaactaccaccacctccagtcagtctcgcctccggctatccgctgctccaccctctggcccggtatcctgcctgtccgctgccaccaaggagagcccggacggagcagcgaggaggggagcagccgggagttggggcttcccccctgcccatccctggccgctggcccgggaccgaagccacttgagcgagcagagagtcgtcaccttgtcttctttgccttcagggagctgctaagaaggacaaataagatagcagagtgaaagagcttttgtctccttagaaggaaggctgagaaactaaaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactacttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattagaacaaactttacttgatatgaaactcctattaacagtctttttttgaaataaaaagtagcttgagctttcttttaaaatcatgtatcttgattgttgatttaatgaaggatttccttttaatgctgcttttgagcttcaaggtaataggacagcaggaacctaaaatatctgccatcatctgccataggaaagatacccagagacccatcatgttctctttttgttgttacactgttgggtgggtataacaattggaaaatgaacaaactgattgattgtgcaaactactttttatgacaagcctaaaccctcataatgcggcagcttaaagtgtatacatatgcactaactttgatcaattatattctcatatctgttagctacacagtctcctattatctcaattgcttatgtgcatatggaatatgttacttaaaacgtgtgcattcttactgaaaatgttttcaaaggaaggtatcagctgtgggctaattgccaccaatttcagcctgccacgattcttggaaatatgtcttccaagtgccatccatcatcagtaggacaagtgtcgggagtttgtttatttttttccagtagcaacgatgggttacatggagccatgaaacctccttctggcctcccttgtgattaatggcatgtgtttgtaaaatggatagctggggttggcagatggctagagaagaatcgcctttggtttaaaatgtatgtggtcccctaatgattgtgaccccattctgtaatcaactgagctagttccaataaagttaagcaggtttaaatccactttgtgcctatcttttcactgacaataaagttagctattttaaaatgca

SEQ ID NO: 450482 - DNA, 6254 bp, Homo sapiens
ggagtgggacatgcgtagaggaggagtcacaacgctgtgcgtacatcggctcacagaggatgtgggctagcttggacagcacacaggaggagcctattcagctatgcctcggagcgagcagagagtcgtcaccttgtcttctttgccttcagggagctgctaagaaggacaaataagatagcagagtgaaagagcttttgtctccttagaaggaaggctgagaaactaaaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactacttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattagaacaaactttacttgatatgaaactcctattaacagtctttttttgaaataaaaagtagcttgagctttcttttaaaatcatgtatcttgattgttgatttaatgaaggatttccttttaatgctgcttttgagcttcaaggtaataggacagcaggaacctaaaatatctgccatcatctgccataggaaagatacccagagacccatcatgttctctttttgttgttacactgttgggtgggtataacaattggaaaatgaacaaactgattgattgtgcaaactactttttatgacaagcctaaaccctcataatgcggcagcttaaagtgtatacatatgcactaactttgatcaattatattctcatatctgttagctacacagtctcctattatctcaattgcttatgtgcatatggaatatgttacttaaaacgtgtgcattcttactgaaaatgttttcaaaggaaggtatcagctgtgggctaattgccaccaatttcagcctgccacgattcttggaaatatgtcttccaagtgccatccatcatcagtaggacaagtgtcgggagtttgtttatttttttccagtagcaacgatgggttacatggagccatgaaacctccttctggcctcccttgtgattaatggcatgtgtttgtaaaatggatagctggggttggcagatggctagagaagaatcgcctttggtttaaaatgtatgtggtcccctaatgattgtgaccccattctgtaatcaactgagctagttccaataaagttaagcaggtttaaatcca

SEQ ID NO: 450483 - DNA, 4883 bp, Homo sapiens
ccaggagctgccttggcagtcacgccccttccttccgaggagctttctggctgcctaaactggtagaccccctgaattactcctccatctccgctctctttcgcctcctcttctcttagttctctccgcctccccctcaactaccaccacctccagtcagtctcgcctccggctatccgctgctccaccctctggcccggtatcctgcctgtccgctgccaccaaggagagcccggacggagcagcgaggaggggagcagccgggagttggggcttcccccctgcccatccctggccgctggcccgggaccgaagccacttgagcgagcagagagtcgtcaccttgtcttctttgccttcagggagctgctaagaaggacaaataagatagcagagtgaaagagcttttgtctccttagaaggaaggctgagaaactaaaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactacttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgttctagtgtggaagtggaggcgattgcttcccagcacaagcccgtttgactgtc

SEQ ID NO: 450484 - DNA, 868 bp, Homo sapiens
  misc_feature (304)..(304): n is a, c, g, or t
ctcttaatattacccctcatgatgatcgctttcaccgcgtacccaagtgttacttgctaggatgcgcggtcccgtaaatatgtgaatcaagcattcaataacgttgaccggtctgtatgctatctaattgcaagagttcggctagcatgtaggataccaagcatgagtgacgtcgtgagtgaactctgcgtgctagagattgacccatcactgtctatgtggcgatgagaagtagagtccgagaacgatcctggccctactatgatactctctagacgtcatctgccgagctaaagtactcaanatatgtgatgagagagtgtactcaagtggtgattgacgggtccactcgcgagtaatgcatcagggttgcctatgggcatggttccgcctatccttgatcatatgactttactgatgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450485 - DNA, 455 bp, Homo sapiens
ggcacgaggtgtatacaagaatctgatccttgtatacagagggaaactgaggtccagagagggaaagtgttgtcccaatgtcacacagcacgttaggactgaaacagtagccccatctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450486 - DNA, 502 bp, Homo sapiens
  misc_feature (117)..(117): n is a, c, g, or t
aggcctggagagaggtgagaggcctggagagaagtgagaggcctggcaggcgagtgtgaaggcctggagagaggtgagaggcctggagagaagtgagaggcctggcaggcgagtgtnaaggcctggagagaggtgagaggcctggagagaggtaagaggcctggcaggtgagtgtgaaggcctggagagaggtgagaggcctggagagaggtgagaggcctggagagaggcgagaggcctggcaggtgagtgtgaaggcctggagggaggtgagaggcctggagagaggtgagaggcctggagagaggtgagaggcctggcaggcgagtgtgaaggcctggagagaggtgagaggcctggagagaggtgagaggcctggagagaggcgagaagtggaagaagggaagccttttgcaaatagtagagtatcagttgcaggtgccaatgactaactttttgaattctatgttggcattaacaataaagcattttgcaaacactg

SEQ ID NO: 450487 - DNA, 2304 bp, Homo sapiens
aaatgctggctgcaatccagccagccctctgccctttctgagcccgagggactgccacctccactgtgtgcacactcagctacgggacacatttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450488 - DNA, 2208 bp, Homo sapiens
aaatgctggctgcaatccagccagccctctgccctttctgagcccgagggactgccacctccactgtgtgcacactcagctacgggacacaaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450489 - DNA, 2060 bp, Homo sapiens
aaatgctggctgcaatccagccagccctctgccctttctgagcccgagggactgccacctccactgtgtgcacactcagctacgggacacaaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450490 - DNA, 1930 bp, Homo sapiens
aaatgctggctgcaatccagccagccctctgccctttctgagcccgagggactgccacctccactgtgtgcacactcagctacgggacacaaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450491 - DNA, 2310 bp, Homo sapiens
aaatgctggctgcaatccagccagccctctgccctttctgagcccgagggactgccacctccactgtgtgcacactcagctacgggacacatttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaaatgctttattgttaatgccaacatagaattcaaaaagttagtcattggcacctgcaactgacactctactatttgcaaaaggtcgacgcg

SEQ ID NO: 450492 - DNA, 2250 bp, Homo sapiens
aaatgctggctgcaatccagccagccctctgccctttctgagcccgagggactgccacctccactgtgtgcacactcagctacgggacacatttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaaagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450493 - DNA, 1733 bp, Homo sapiens
gccccacaagaggaaattcatcgaacctcgtgccgaattcggcacgagtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450494 - DNA, 1692 bp, Homo sapiens
aaatgctggctgcaatccagccagccctctgccctttctgagcccgagggactgccacctccactgtgtgcacactcagctacgggacacagggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450495 - DNA, 1787 bp, Homo sapiens
aaatgctggctgcaatccagccagccctctgccctttctgagcccgagggactgccacctccactgtgtgcacactcagctacgggacacatttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccttttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450496 - DNA, 1367 bp, Homo sapiens
aaatgctggctgcaatccagccagccctctgccctttctgagcccgagggactgccacctccactgtgtgcacactcagctacgggacacaaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagagggtactttcagactaccccagggccagcctaaacccacacagccccagggagacacacacgccctaccagggccacacagcactggtgggaaggactcacccagccaaggagctgcctccaggcccagaggcatcctgtgacatccaagtcctgggggcctagcccagttggagggacaagagctggaaactgggttccttagggtggtgccagagtgggcagagacctctgggcagcccacgtccaagtccagagcaaggggaggctcatccaggtaacaagcacgcacacccaggcgagttccccatgctcgtccccacgttgatatctcagactctacaagtcttcagctgctgcctaggactctg

SEQ ID NO: 450497 - DNA, 2679 bp, Homo sapiens
  misc_feature (2529)..(2529): n is a, c, g, or t
aaatgctggctgcaatccagccagccctctgccctttctgagcccgagggactgccacctccactgtgtgcacactcagctacgggacacatttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactgaaaaaaaaaaaaaaaaaaaaaaaaaaaaaaaaaaaaaaaaaaaaaaaaaaaaaaaaacaaaaaaaaaaaaaaaaaaacaaaaaaaacaaaaaaaaaaccaaaaaaatcaaaacacaaaccccaaaaactatcacatgcgcacctaccctcccctaccattaaaaaaaaactttttccccctcttccccacattttttctttatctccccccttttttcttatccnccccctattcccgcccttttttcccattccccctcaaggggggctcctcacaaatatatgcggcgcggtttttaacacgcgcgtcgcgtcgacccgtgggtgcccccactttccggtttcccacacactcccctctttcaccgcggctgt

SEQ ID NO: 450498 - DNA, 2159 bp, Homo sapiens
aaatgctggctgcaatccagccagccctctgccctttctgagcccgagggactgccacctccactgtgtgcacactcagctacgggacacaaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450499 - DNA, 2160 bp, Homo sapiens
taaggccatggggacaaaatgtcggctggataggaggtgctcaaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450500 - DNA, 1936 bp, Homo sapiens
taaggccatggggacaaaatgtcggctggataggaggtgctcaaacaaagaacagccaccatgcagctcttcctcctcttgtgctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450501 - DNA, 2250 bp, Homo sapiens
aaatgctggctgcaatccagccagccctctgccctttctgagcccgagggactgccacctccactgtgtgcacactcagctacgggacacatttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggagtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450502 - DNA, 1629 bp, Homo sapiens
gtgatccccccacgacccgaagactgcagggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 450503 - DNA, 1149 bp, Homo sapiens
aaatgctggctgcaatccagccagccctctgccctttctgagcccgagggactgccacctccactgtgtgcacactcagctacgggacacaaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtgtgtaacctacatccgatatatccggctacaggttcaactctttatacccaggtatatctagat

SEQ ID NO: 450504 - DNA, 858 bp, Homo sapiens
aaatgctggctgcaatccagccagccctctgccctttctgagcccgagggactgccacctccactgtgtgcacactcagctacgggacacatttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaaggtaaggcccttgggcccaaacctgcaatttctttg

SEQ ID NO: 450505 - DNA, 6554 bp, Homo sapiens
gggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgactgccgggtaaagttgtggaattacgtccctggactcaccccctgccttcctcgccgagtcctggccataaagggccgcgccaccaccctgccctgaccctccccaactctccctgtctcctctttcattcttcccctctttccttttccctctctttccccacttcgatctgagctgcttcttaacgtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaatgtc

SEQ ID NO: 450506 - DNA, 6324 bp, Homo sapiens
gggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaatgtc

SEQ ID NO: 450507 - DNA, 5985 bp, Homo sapiens
atcaaggaacacattatgcaaatgcttcaaaatcctgactggaaataccggcatgcaggattgatggccttatctggctggacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaatgtc

SEQ ID NO: 450508 - DNA, 6411 bp, Homo sapiens
gggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaaatttgtggggcgccccccaaaaaggggccaattatatatctttcgcaaccccaaaggggggccccctctcacagttgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaatgtc

SEQ ID NO: 450509 - DNA, 3715 bp, Homo sapiens
  misc_feature (16)..(16): n is a, c, g, or t
  misc_feature (23)..(23): n is a, c, g, or t
tccatgtggtacgccncgagtantcgattcgtcgaccgagcctcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaatgtc

SEQ ID NO: 450510 - DNA, 6425 bp, Homo sapiens
gggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaatgtcaaaaaaaacacaaggggggggcaaaatacccggggcagattcggttcggttttggaagggca

SEQ ID NO: 450511 - DNA, 6415 bp, Homo sapiens
  misc_feature (6409)..(6409): n is a, c, g, or t
gggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaatgtcggcaggcagagacacagcactgactccagcatcccttgtgttgaanagatgt

SEQ ID NO: 450512 - DNA, 6363 bp, Homo sapiens
gggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaatgtc

SEQ ID NO: 450513 - DNA, 6979 bp, Homo sapiens
gggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgactgccgggtaaagttgtggaattacgtccctggactcaccccctgccttcctcgccgagtcctggccataaagggccgcgccaccaccctgccctgaccctccccaactctccctgtctcctctttcattcttcccctctttccttttccctctctttccccacttcgatctgagctgcttcttaacggtatgagattattttactccttcttcttcctttcccttcctgtcctgcctggcctagagaggtgccctgcctgtccctcctgcacccaccgtccttttccaagcatgaacagtgggacaggccccaggagatgggtgccagggagcagaagggggagccttcaggcctggacaaaacgaaacacccccccaaaaaaagaaaacccatgacaaagctcccctgggggcctctgagtgcacaggcctctccatctgcccagcaccccaccacctgcagtccacctccccgtaagccatgcttgcctcccagccccaaccacatttggggagtttggggaatccagttcatcctctacttttgggggcagccagccaagcccactgcaagagctgaccggcacccctccactttgtcctccaccccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaatgtc

SEQ ID NO: 450514 - DNA, 5420 bp, Homo sapiens
ccccgactagcccgacagcggggacttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaatgtc

SEQ ID NO: 450515 - DNA, 3228 bp, Homo sapiens
ttgtcgaccacgcgtcgccacgcgtcggagcgtcaggcgggccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaatgtc

SEQ ID NO: 450516 - DNA, 2019 bp, Homo sapiens
  misc_feature (12)..(12): n is a, c, g, or t
taaggctcggancgcctcggccacgggtgacgcacgagcgcacgcggtgcgccgaaggggactgaggcccggagaggtgccacacagcccatctgcgtatgagggcgcacccacgggcgcagccgcgcccggcacggcatgatctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaatgtc

SEQ ID NO: 450517 - DNA, 686 bp, Homo sapiens
cataactgtaagaaataaattccttttctttataaattaaccagtttcagatattctattataagcaatagaaagcagactaagatagaatctttgaaacaaaatggtaattcttgaactattaataaatactctttttgctacatgtccctattacttgatagtaatcgtgttcttgagtttccttatgtatagattatgtgtcagaggacctaactcactggaagcgtggtgtgggcactaaaattattattacttttttgagacggagtctcactctgttgcccaggctgtagtgcaatggtgcgatctcagctcactgcagcctccgcctcctgggttcaagcaattctcctgcctcagcctcccgagtagctgggattacaggcgtgcaccaccacacccagctaatttttgtatttttagtagatacgaggttttaccatgttggccaggctggtctcgaactcctgacctcgtgatccgcccacctcggcctcccgaagtgttgggattacaggtgtgagccaccgcacctggcctgaaaattctctccaaattctcagatgcctagtcaactcaacgtaagatgtttgcctgggtttagggcaaactatggcctgtggggccgaatctgtgcctgtgtttataaataaaattgaaacacagccacgtccatttattta

SEQ ID NO: 450518 - DNA, 5619 bp, Homo sapiens
ggtgtgagaggtcagtgtttcttcctggcctattcggggcagggccccctcgagtcctcccaccctacagctcctcagggccctggctgcctcaagcccccactgcactgtctggaaactcccagataatctgatcatgtaacgcggcagcaggacactaagggccattcgcccaaagatttttaaaaactctttttagaacagatagagaaaaccacccaaattaaatgcatggcttaatgaattattataaggcaaatgccactttgatcaagaagtggaaggccaccggtttctcagaagccccttccaggcccatatggccacagccccgtccagcatgtcttgatgtgtcttgtgcgcctgccctgtttttattttgatagttttgtgacccatatgagcatccgtgggcactgtagcttactgttgccaattaaaatattgttttttcttttgttttgttttgttttgttttgttttgttttttcatggagtctcactctgttgtccaggttagagtgcagtggtgtgatctcagatcactgcaacctttgcctcctgggttcaagtgactctcctgtctcagctttctgagtagctgggattacaggcacctgccaccacaccctgctaattttttttgtatttttagtagagacagggttttgccatgttggtcaggctggtcttgaacttctgacctcaagtgatctgcccgccttggcctctccaagtgctggaattacaggtgtgagccaccgtgtccggcctaaaatattgttgatatgtgttttaagtctttttaagcctatgctcccccatttccttacacttggccatagtcacatccagccatttttctctggtgtcctttggtctgggttgtgcctgttgtccctctgcctctgtgtttcctgcacgtgggcagttagatcctgagatgggatcaggctccactcagctgctgtggaagaataaaggggattcggatgtctgtcctctcatgctcctcgaagctgatgatgcttgatgccattcttggccttttttgcttttattttttgtagttcttaaggggtttaaaaaatcgtggcataaggtaatgcaaaaaggtgtccatgtgttaaacgtacaactagacggactctgcagtgtgcccacctgtcctgctgctggaggccatttgaggagccagctgcctctcacagctatggactgcagcctatgcatgcctatttcctagtgacctggtgtgaacatggtggagtggggggacaagctcctgatgctcctttcctgtctctgcagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtaaggatggtgaaccctgtttgggaccccatgctggtgtcaggggagagagcctgaggctcgaggcttgtggagaggttcatggaagggggacgcctgggttctggtgagggtgtggctctccaggtcctgctgtcgaaatgcccggtggggccaggccccaggtcttcagaaagatctgacaggcagcagcagggagtctgacttggtgctggaggacatctcaaggcccctgctcctgcactcctgccctctgacttaaactgccggcctcaggccatcgctttggcatccttctcacctctaggctgcttgcccagatccagccctttctcaaagccagggccagctgcccgccacttctgtgtccccagccctgcccctgagccttcagggctgtccctcaaaccatgttaggcatggcctagaaccatctccattaaattgagatcactttgaagacaaggtgatgactggctcccttgggcatcgtcctcccacacagcacagtgtcttcaaatattttctttaatgtaagcagatcatggtggctctgcccaaaggctgctgctccagtgttccatggcactgacaactgtgcatggactgtgttatcacctcccagtgctccatccctgcctttgggggctgggtgtgctcaaggaagaagttgtaggggcaagaccagggattaagggccatggcccaggtgctgtctcaggccaccacttcagcccttagaagctcagtgttccatgtggaggggatggtgtgggtagtgggtttacaggaaccaggggtgtgcatgccgggcacatggccctgctccctgggacacacgcagtggcagctgtactgtcaccaggggaagcaccagtcaccactttagagcccatgtgagtgtgatcgagtgaaagctctgtgttaatgctccatgggttattaaatccacgtagtatcaccttgaactaggccatcaccctaagcctggtgaagactgttcctgaatgtgccgcccatggatctggggagtgcttggaggagagcggccattggggacctgtcccatggggcttctttccatctttcactggcgggggtggggggttggggggatccctttcatatggacatatgcgcgtctgcacatgcccagcactcaggaagtcttggctgatctctgagtttaaagtaaaccatgtcagctctcctgctgacagtgaatttcggcctttctgtaggtcggtactgggagacagtagagaggttgaagatcaatcagttctatggcgccccaacggctgtccggctgttgctgaaatacggtgatgcctgggtgaagaagtatgatcgctcctccctgcggaccctggggtcaggtgagcggcctgccctgcagcaggagaggttgtgcttgccctagaccctcagagccaatacgggcttcagcaggacttcagtcatgaagctgcccggctttgtatgtgtgaattcacgcaatgccagaccggatctggtagaaagcaccagcacctcttcccacctgtaagctcctccccagagctggcagcagttacctgtctggggaacaacgttccagacattttctgtgccgttgtttctgtgcccaatttctgtagcttaatcttcattaggaatacttacccactcaataagttaagggtcaggtcagttctttagtggctgcatgggatttaactgtataacttagctgggtgtggtggcaaaggctgaggtgggaggattgcttgagcccaggagtttcaggctgcagtgaactaggattgcaccactgcgctccagcctggtgacagagtgagactcagtcgtctaaataatagtaataatagtataactacagtttgctaaacactgccccatagttggaccttttgattgtctccaagtctgtggagtggataccatcctgcacttttgccctgctgttactgtagacatttccaggcagacagttcaaagcttaggcctattggtaatgttgatggatattgccaaatcacatggaaacattttggaaatgtgatggtggcatggtttcgacagtatcagcagtgtctgtctttcgggctggtgctgggagggactgggtgctggtgactgctgttctctctcctgtccctgccacatttcatgtctgccttgacgtgtggtcacgcgtggtcagccacctgcttggtggcttttcactggggaagcatgcagggcagtgaccatggaagagtgtcccattctgccacatacatccttgggaagggagcatgtacctcccagtgaacatgtgattccactactactgggtgaccatgaggccatgcgggcatccgggccacaggctgagaggcacagcagctggggctgtgccctgcagagctcaccacttgttcccaaatgtgagatggggatgagacctacctacagggtggcgaggatgccacagagggtcagatgtgagccttagtataatgttcagcatggagatgattaatggagagagctcctgaggaatagcaggcatccaatgactcctcctcctcttttcccttattttccccattaacagtaaaaaccttctgtttctcaaccagctttctagattaaaaagcaggaggagtttgaatactattaataagagcaaatatgtattaaatgcctttatcttcacatcagtcctttgagcaaacagcagatgttgtttcacattacagagaaggaagaggaggcacagagaggtcagagaaccggcctgaggtcactcagcaagtagggcagcctgtgttgaacgcagcacttggttctagagtctgtaaaactcactctgccccccacctgattgatgggctctgtgcccccaccctgtaccctcaacaggtcccttgccatactgtcccctccacctctcagaaagagtatggggttcctttctagatggtgaatcttagtttgctttgtgctgctgtaatagaataccctgaaactgggtgatttataatgaactcagcgtgagatttggaggggacaaacattcaaaccataataagtggtgagtttgggtggtctctcttggcatgctggagctgggcttgagaggcccgtgtgattctgactgcctgggccatgtagtgcttgtggactgggaacaaacagcggggtggccagggccatagaaactcgcccagatcctctaggtgttgtcagcagggccacctgagtgggccctaggcattaggtggggacagggctgaagggcaagatttggttttccagatacactcatgggatttgtctcctgaaggaaggttcacggggtccaatgacaaggggtaccgccctaagtgcatttcaggaaggggtgtgctctggcagctgcattagagtgggatgtgtatcccagcagcctctgcctcacctaggggtccccacagacttggaacacctctgagccagggggccagcccccagcagaggctcagctgggttttgtgtatttagctggttgataggcacattcctattcctgttgcataaccggttctagccgcagagccctgcgggaggccaggtgctaatcacacacctcgctgttctgttctcggtatacagtgttggcaggcagcgtggcgtcttgtgatgtcttgcacctggggctcccagcacctcggagcagtgctgggagtcagtgtgttccacaccttggccagggccagcgctgtgctggcacacctgtcggtgcaattccacagcccagacccattccaggcagctgggatcagccctcatgacatttaatccgttgagtcgtcagaatcccactcactcaagacattccccctagatttgtatttctcaaagcttttttaaactttcaatttcataagtaatacatggatacactcttgtgaaaagaagaaattggagcattgtacttaaagctgatgtccttaggagctgggcgtggtggtacgtgcctgtagtccctcggctacttgggaggctgagatgggaggatccttgagccccagaagtcgaggttgcagtgagccatgatcatgccactgcactccagtccaggcaacagagcaagatccttgtctctctctctcaaaaaaaaagaaaaaaaa

SEQ ID NO: 450519 - DNA, 1405 bp, Homo sapiens
gaggcaccgagaagttaaggaacttgctcaaggtcacagagtttgaactcaggctacagatgctgcagcaactggagaaagtcctcatcgccccatatcacccaccaccgacccccagcaggacgtgacccccgccaggacggaggccggcagctggggggctggagcatgggacccagaacacggactcaggcttgcgcagcctcctggcttctaggcgggagcctagaaaggcgccagcccctttcgcgtgctgctgagactccaggggtggggttcactctcaggggcgcacaaaggcatgaaaaccttggcttcagcctctgagatgcggaactgaccgacctattgtcttgggacccaccagtgcgcttgggtgcaccagcccccttaacgttggtgccggctccctcccggctcctccccatcccagagggtcccctcgccccaggccctgagcctgcgtcctggggtcctgggccgcacgtgcctctggcagctcgaagaagctgtcggggcttgcaggagagcgtgcaaactgaaaccaaaacaggccgactcgaggaacatccgggtgggaccgcagactcaccggagcgcagcgcctgggccagggcctgggaccctgctccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacaggataagtgaatgtgaccgcaagcagagtgccccccagtgctagccggtgtagcgtgcctggggactctctcagcgccgtgtcgggcgggccaattagggattctttt

SEQ ID NO: 450520 - DNA, 3949 bp, Homo sapiens
ggtgtgagaggtcagtgtttcttcctggcctattcggggcagggccccctcgagtcctcccaccctacagctcctcagggccctggctgcctcaagcccccactgcactgtctggaaactcccagataatctgatcatgtaacgcggcagcaggacactaagggccattcgcccaaagatttttaaaaactctttttagaacagatagagaaaaccacccaaattaaatgcatggcttaatgaattattataaggcaaatgccactttgatcaagaagtggaaggccaccggtttctcagaagccccttccaggcccatatggccacagccccgtccagcatgtcttgatgtgtcttgtgcgcctgccctgtttttattttgatagttttgtgacccatatgagcatccgtgggcactgtagcttactgttgccaattaaaatattgttttttcttttgttttgttttgttttgttttgttttgttttttcatggagtctcactctgttgtccaggttagagtgcagtggtgtgatctcagatcactgcaacctttgcctcctgggttcaagtgactctcctgtctcagctttctgagtagctgggattacaggcacctgccaccacaccctgctaattttttttgtatttttagtagagacagggttttgccatgttggtcaggctggtcttgaacttctgacctcaagtgatctgcccgccttggcctctccaagtgctggaattacaggtgtgagccaccgtgtccggcctaaaatattgttgatatgtgttttaagtctttttaagcctatgctcccccatttccttacacttggccatagtcacatccagccatttttctctggtgtcctttggtctgggttgtgcctgttgtccctctgcctctgtgtttcctgcacgtgggcagttagatcctgagatgggatcaggctccactcagctgctgtggaagaataaaggggattcggatgtctgtcctctcatgctcctcgaagctgatgatgcttgatgccattcttggccttttttgcttttattttttgtagttcttaaggggtttaaaaaatcgtggcataaggtaatgcaaaaaggtgtccatgtgttaaacgtacaactagacggactctgcagtgtgcccacctgtcctgctgctggaggccatttgaggagccagctgcctctcacagctatggactgcagcctatgcatgcctatttcctagtgacctggtgtgaacatggtggagtggggggacaagctcctgatgctcctttcctgtctctgcagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcagtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattt

SEQ ID NO: 450521 - DNA, 4302 bp, Homo sapiens
gaggcaccgagaagttaaggaacttgctcaaggtcacagagtttgaactcaggctacagatgctgcagcaactggagaaagtcctcatcgccccatatcacccaccaccgacccccagcaggacgtgacccccgccaggacggaggccggcagctggggggctggagcatgggacccagaacacggactcaggcttgcgcagcctcctggcttctaggcgggagcctagaaaggcgccagcccctttcgcgtgctgctgagactccaggggtggggttcactctcaggggcgcacaaaggcatgaaaaccttggcttcagcctctgagatgcggaactgaccgacctattgtcttgggacccaccagtgcgcttgggtgcaccagcccccttaacgttggtgccggctccctcccggctcctccccatcccagagggtcccctcgccccaggccctgagcctgcgtcctggggtcctgggccgcacgtgcctctggcagctcgaagaagctgtcggggcttgcaggagagcgtgcaaactgaaaccaaaacaggccgactcgaggaacatccgggtgggaccgcagactcaccggagcgcagcgcctgggccagggcctgggaccctgctccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcagtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattt

SEQ ID NO: 450522 - DNA, 4013 bp, Homo sapiens
gaggcaccgagaagttaaggaacttgctcaaggtcacagagtttgaactcaggctacagatgctgcagcaactggagaaagtcctcatcgccccatatcacccaccaccgacccccagcaggacgtgacccccgccaggacggaggccggcagctggggggctggagcatgggacccagaacacggactcaggcttgcgcagcctcctggcttctaggcgggagcctagaaaggcgccagcccctttcgcgtgctgctgagactccaggggtggggttcactctcaggggcgcacaaaggcatgaaaaccttggcttcagcctctgagatgcggaactgaccgacctattgtcttgggacccaccagtgcgcttgggtgcaccagcccccttaacgttggtgccggctccctcccggctcctccccatcccagagggtcccctcgccccaggccctgagcctgcgtcctggggtcctgggccgcacgtgcctctggcagctcgaagaagctgtcggggcttgcaggagagcgtgcaaactgaaaccaaaacaggccgactcgaggaacatccgggtgggaccgcagactcaccggagcgcagcgcctgggccagggcctgggaccctgctccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcagtgagaaccactgaggtccaatgatgagacttggaggtctggatccagtctctctttgttttaatagcttccctgaagaacccaactatttggagtatgttgcctttcggagaaga

SEQ ID NO: 450523 - DNA, 5864 bp, Homo sapiens
ggtgtgagaggtcagtgtttcttcctggcctattcggggcagggccccctcgagtcctcccaccctacagctcctcagggccctggctgcctcaagcccccactgcactgtctggaaactcccagataatctgatcatgtaacgcggcagcaggacactaagggccattcgcccaaagatttttaaaaactctttttagaacagatagagaaaaccacccaaattaaatgcatggcttaatgaattattataaggcaaatgccactttgatcaagaagtggaaggccaccggtttctcagaagccccttccaggcccatatggccacagccccgtccagcatgtcttgatgtgtcttgtgcgcctgccctgtttttattttgatagttttgtgacccatatgagcatccgtgggcactgtagcttactgttgccaattaaaatattgttttttcttttgttttgttttgttttgttttgttttgttttttcatggagtctcactctgttgtccaggttagagtgcagtggtgtgatctcagatcactgcaacctttgcctcctgggttcaagtgactctcctgtctcagctttctgagtagctgggattacaggcacctgccaccacaccctgctaattttttttgtatttttagtagagacagggttttgccatgttggtcaggctggtcttgaacttctgacctcaagtgatctgcccgccttggcctctccaagtgctggaattacaggtgtgagccaccgtgtccggcctaaaatattgttgatatgtgttttaagtctttttaagcctatgctcccccatttccttacacttggccatagtcacatccagccatttttctctggtgtcctttggtctgggttgtgcctgttgtccctctgcctctgtgtttcctgcacgtgggcagttagatcctgagatgggatcaggctccactcagctgctgtggaagaataaaggggattcggatgtctgtcctctcatgctcctcgaagctgatgatgcttgatgccattcttggccttttttgcttttattttttgtagttcttaaggggtttaaaaaatcgtggcataaggtaatgcaaaaaggtgtccatgtgttaaacgtacaactagacggactctgcagtgtgcccacctgtcctgctgctggaggccatttgaggagccagctgcctctcacagctatggactgcagcctatgcatgcctatttcctagtgacctggtgtgaacatggtggagtggggggacaagctcctgatgctcctttcctgtctctgcagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtaaggatggtgaaccctgtttgggaccccatgctggtgtcaggggagagagcctgaggctcgaggcttgtggagaggttcatggaagggggacgcctgggttctggtgagggtgtggctctccaggtcctgctgtcgaaatgcccggtggggccaggccccaggtcttcagaaagatctgacaggcagcagcagggagtctgacttggtgctggaggacatctcaaggcccctgctcctgcactcctgccctctgacttaaactgccggcctcaggccatcgctttggcatccttctcacctctaggctgcttgcccagatccagccctttctcaaagccagggccagctgcccgccacttctgtgtccccagccctgcccctgagccttcagggctgtccctcaaaccatgttaggcatggcctagaaccatctccattaaattgagatcactttgaagacaaggtgatgactggctcccttgggcatcgtcctcccacacagcacagtgtcttcaaatattttctttaatgtaagcagatcatggtggctctgcccaaaggctgctgctccagtgttccatggcactgacaactgtgcatggactgtgttatcacctcccagtgctccatccctgcctttgggggctgggtgtgctcaaggaagaagttgtaggggcaagaccagggattaagggccatggcccaggtgctgtctcaggccaccacttcagcccttagaagctcagtgttccatgtggaggggatggtgtgggtagtgggtttacaggaaccaggggtgtgcatgccgggcacatggccctgctccctgggacacacgcagtggcagctgtactgtcaccaggggaagcaccagtcaccactttagagcccatgtgagtgtgatcgagtgaaagctctgtgttaatgctccatgggttattaaatccacgtagtatcaccttgaactaggccatcaccctaagcctggtgaagactgttcctgaatgtgccgcccatggatctggggagtgcttggaggagagcggccattggggacctgtcccatggggcttctttccatctttcactggcgggggtggggggttggggggatccctttcatatggacatatgcgcgtctgcacatgcccagcactcaggaagtcttggctgatctctgagtttaaagtaaaccatgtcagctctcctgctgacagtgaatttcggcctttctgtaggtcggtactgggagacagtagagaggttgaagatcaatcagttctatggcgccccaacggctgtccggctgttgctgaaatacggtgatgcctgggtgaagaagtatgatcgctcctccctgcggaccctggggtcaggtgagcggcctgccctgcagcaggagaggttgtgcttgccctagaccctcagagccaatacgggcttcagcaggacttcagtcatgaagctgcccggctttgtatgtgtgaattcacgcaatgccagaccggatctggtagaaagcaccagcacctcttcccacctgtaagctcctccccagagctggcagcagttacctgtctggggaacaacgttccagacattttctgtgccgttgtttctgtgcccaatttctgtagcttaatcttcattaggaatacttacccactcaataagttaagggtcaggtcagttctttagtggctgcatgggatttaactgtataacttagctgggtgtggtggcaaaggctgaggtgggaggattgcttgagcccaggagtttcaggctgcagtgaactaggattgcaccactgcgctccagcctggtgacagagtgagactcagtcgtctaaataatagtaataatagtataactacagtttgctaaacactgccccatagttggaccttttgattgtctccaagtctgtggagtggataccatcctgcacttttgccctgctgttactgtagacatttccaggcagacagttcaaagcttaggcctattggtaatgttgatggatattgccaaatcacatggaaacattttggaaatgtgatggtggcatggtttcgacagtatcagcagtgtctgtctttcgggctggtgctgggagggactgggtgctggtgactgctgttctctctcctgtccctgccacatttcatgtctgccttgacgtgtggtcacgcgtggtcagccacctgcttggtggcttttcactggggaagcatgcagggcagtgaccatggaagagtgtcccattctgccacatacatccttgggaagggagcatgtacctcccagtgaacatgtgattccactactactgggtgaccatgaggccatgcgggcatccgggccacaggctgagaggcacagcagctggggctgtgccctgcagagctcaccacttgttcccaaatgtgagatggggatgagacctacctacagggtggcgaggatgccacagagggtcagatgtgagccttagtataatgttcagcatggagatgattaatggagagagctcctgaggaatagcaggcatccaatgactcctcctcctcttttcccttattttccccattaacagtaaaaaccttctgtttctcaaccagctttctagattaaaaagcaggaggagtttgaatactattaataagagcaaatatgtattaaatgcctttatcttcacatcagtcctttgagcaaacagcagatgttgtttcacattacagagaaggaagaggaggcacagagaggtcagagaaccggcctgaggtcactcagcaagtagggcagcctgtgttgaacgcagcacttggttctagagtctgtaaaactcactctgccccccacctgattgatgggctctgtgcccccaccctgtaccctcaacaggtcccttgccatactgtcccctccacctctcagaaagagtatggggttcctttctagatggtgaatcttagtttgctttgtgctgctgtaatagaataccctgaaactgggtgatttataatgaacagaaatttattggttcacatttctggaggctgggaagtccacatcaaggtgttggcatctggtgagggccttcttgctgcatcgtcccatggtggaagggcaaagagaaggcaagagagagcaagaggaggttgaactcacccttttataatggcaccaatcccactcatgagggtggaaacctcttggcataatcacctcataaaggttccacctcttaatactgttacaatggcaattacatttcagcgtgagatttggaggggacaaacattcaaaccataataagtggtgagtttgggtggtctctcttggcatgctggagctgggcttgagaggcccgtgtgattctgactgcctgggccatgtagtgcttgtggactgggaacaaacagcggggtggccagggccatagaaactcgcccagatcctctaggtgttgtcagcagggccacctgagtgggccctaggcattaggtggggacagggctgaagggcaagatttggttttccagatacactcatgggatttgtctcctgaaggaaggttcacggggtccaatgacaaggggtaccgccctaagtgcatttcaggaaggggtgtgctctggcagctgcattagagtgggatgtgtatcccagcagcctctgcctcacctaggggtccccacagacttggaacacctctgagccagggggccagcccccagcagaggctcagctgggttttgtgtatttagctggttgataggcacattcctattcctgttgcataaccggttctagccgcagagccctgcgggaggccaggtgctaatcacacacctcgctgttctgttctcggtatacagtgttggcaggcagcgtggcgtcttgtgatgtcttgcacctggggctcccagcacctcggagcagtgctgggagtcagtgtgttccacaccttggccagggccagcgctgtgctggcacacctgtcggtgcaattccacagcccagacccattccaggcagctgggatcagccctcatgacatttaatccgttgagtcgtcagaatcccactcactcaagacattccccctagatttgtatttctcaaagcttttttaaactttcaatttcataagtaatacatggatacactcttgtgaaaagaagaaattggagcattgtacttaaagctgatgtccttaggagctgggcgtggtggtacgtgcctgtagtccctcggctacttgggaggctgagatgggaggatccttgagccccagaagtcgaggttgcagtgagccatgatcatgccactgcactccagtccaggcaacagagcaagatccttgtctctctctctcaaaaaaaaagaaaaaaaa

SEQ ID NO: 450524 - DNA, 4465 bp, Homo sapiens
gaggcaccgagaagttaaggaacttgctcaaggtcacagagtttgaactcaggctacagatgctgcagcaactggagaaagtcctcatcgccccatatcacccaccaccgacccccagcaggacgtgacccccgccaggacggaggccggcagctggggggctggagcatgggacccagaacacggactcaggcttgcgcagcctcctggcttctaggcgggagcctagaaaggcgccagcccctttcgcgtgctgctgagactccaggggtggggttcactctcaggggcgcacaaaggcatgaaaaccttggcttcagcctctgagatgcggaactgaccgacctattgtcttgggacccaccagtgcgcttgggtgcaccagcccccttaacgttggtgccggctccctcccggctcctccccatcccagagggtcccctcgccccaggccctgagcctgcgtcctggggtcctgggccgcacgtgcctctggcagctcgaagaagctgtcggggcttgcaggagagcgtgcaaactgaaaccaaaacaggccgactcgaggaacatccgggtgggaccgcagactcaccggagcgcagcgcctgggccagggcctgggaccctgctccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcagtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattt

SEQ ID NO: 450525 - DNA, 4394 bp, Homo sapiens
gaggcaccgagaagttaaggaacttgctcaaggtcacagagtttgaactcaggctacagatgctgcagcaactggagaaagtcctcatcgccccatatcacccaccaccgacccccagcaggacgtgacccccgccaggacggaggccggcagctggggggctggagcatgggacccagaacacggactcaggcttgcgcagcctcctggcttctaggcgggagcctagaaaggcgccagcccctttcgcgtgctgctgagactccaggggtggggttcactctcaggggcgcacaaaggcatgaaaaccttggcttcagcctctgagatgcggaactgaccgacctattgtcttgggacccaccagtgcgcttgggtgcaccagcccccttaacgttggtgccggctccctcccggctcctccccatcccagagggtcccctcgccccaggccctgagcctgcgtcctggggtcctgggccgcacgtgcctctggcagctcgaagaagctgtcggggcttgcaggagagcgtgcaaactgaaaccaaaacaggccgactcgaggaacatccgggtgggaccgcagactcaccggagcgcagcgcctgggccagggcctgggaccctgctccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcagtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggttagctttccatgttgctgagaggaacctggacatggtcccgggcatctgaatgatctgtaggggagggagttcaaataaagctttattttgttcattt

SEQ ID NO: 450526 - DNA, 3408 bp, Homo sapiens
gaggcaccgagaagttaaggaacttgctcaaggtcacagagtttgaactcaggctacagatgctgcagcaactggagaaagtcctcatcgccccatatcacccaccaccgacccccagcaggacgtgacccccgccaggacggaggccggcagctggggggctggagcatgggacccagaacacggactcaggcttgcgcagcctcctggcttctaggcgggagcctagaaaggcgccagcccctttcgcgtgctgctgagactccaggggtggggttcactctcaggggcgcacaaaggcatgaaaaccttggcttcagcctctgagatgcggaactgaccgacctattgtcttgggacccaccagtgcgcttgggtgcaccagcccccttaacgttggtgccggctccctcccggctcctccccatcccagagggtcccctcgccccaggccctgagcctgcgtcctggggtcctgggccgcacgtgcctctggcagctcgaagaagctgtcggggcttgcaggagagcgtgcaaactgaaaccaaaacaggccgactcgaggaacatccgggtgggaccgcagactcaccggagcgcagcgcctgggccagggcctgggaccctgctccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattt

SEQ ID NO: 450527 - DNA, 2093 bp, Homo sapiens
  misc_feature (737)..(737): n is a, c, g, or t
gggcagtcgtaggagactctgaaaaagcaaataaatcaatgttaaatcagaaatgtgaatgtagtaaggggctgaagagacaggggaagagaatacatgggaaaatattgaaaaggacagagtgatcaaaaagagcagggacatgggagcattgggcagcacactgggagccatttcactttatgctcttattgtatgattgagaaaaaaatgtccttagtggttaagtggcttttcaatgccacatcagacttgttccatagcagttgaattaggggaaggtgaataagttggaggttggtgacaaggagagaagctggaacagagaggagagtcagaaccagagggaaatgagagactgagtaggcatctcagggtttttgaaggagtggattttctttgttgcagtcaggggaggtttgtctgttggctgcagaaagaagtcagaatagagatatcgtggggtaggtttgtttggaacagaaatcaaagaccaatttttctgagagaaggaaataacatctgcaaatgatatgctgtttttgctacttccattgttagctgttctcccaggtgatggcaatgcagacgggctcaaggagcctctctccttccatgtcacctggatcgcatccttttacaaccattcctggaaacaaaatctggtctcaggttggctgagtgatttgcagactcatacctgggacagcaattccagcaccatcgttttcctgtgnccctggtccaggggaaacttcagcaatgaggagtggaaggaactggaaacattattccgtatacgcaccattcggtcatttgagggaattcgtagatacgcccatgaattgcagtttgaatatccttttgagatacaggtgacaggaggctgtgagctgcactctggaaaggtctcaggaagcttcttgcagttagcttatcaaggatcagactttgtgagcttccagaacaattcatggttgccatatccagtggctgggaatatggccaagcatttctgcaaagtgctcaatcagaatcagcatgaaaatgacataacacacaatcttctcagtgacacctgcccacgtttcatcttgggtcttcttgatgcaggaaaggcacatctccagcggcaagtgaagcccgaggcctggctgtcccatggccccagtcctggccctggccatctgcagcttgtgtgccatgtctcaggattctacccaaagcccgtgtgggtgatgtggatgcggggtgagcaggagcagcagggcactcagcgaggggacatcttgcccagtgctgatgggacatggtatctccgcgcaaccctggaggtggccgctggggaggcagctgacctgtcctgtcgggtgaagcacagcagtctagagggccaggacatcgtcctctactgggagcatcacagttccgtgggcttcatcatcttggcggtgatagtgcctttacttcttctgataggtcttgcgctttggttcaggaaacgctgtttctgttaagacacaccatgagcctcctcgtcacccttctccttttggggtgagagaccagcagcccaagggctccagacacacctgaacacatcgtgatgatgacgtcctctcaactctctttgtaaaaattttgttatttttgcttgtttctgattaatgattgtttgtcaatataagctcaatttaattttgcaggatttgttgttctgacctgggttctgggacttttaaattcaaattttatctccagatggaatggggtcctagcaacctccacatgttcaactattaatggatcatcaggcctgttttagatatcccttactccagagggccttccctgacttacaagtgggaagcagtctcttcctggtctgaactcccgccacattttagccgtactttgctaactgtgctcctcacttcctcttcttcattgcagttatttagatcccccctttccttctaatttttcagctccttcaatgcaaagtacatgtatttttaatatatgcatccctggtgaaggatcttgcctgcatgaaacatgttctcaataaaactctgtgttgaatttatgcc

SEQ ID NO: 450528 - DNA, 1671 bp, Homo sapiens
  misc_feature (315)..(315): n is a, c, g, or t
caagatcttcattgctcatcagaggattccggcgagggtctcgctctgtgcagtggtgtgatcttggctcactttagcctcaacctcccgagtagctgggattacagatgtgacttgctcctccttgcattctgccatgattttgaggcctcctcagccatgtggaactggctcaaggagcctctctccttccatgtcacctggatcgcatccttttacaaccattcctggaaacaaaatctggtctcaggttggctgagtgatttgcagactcatacctgggacagcaattccagcaccatcgttttcctgtgnccctggtccaggggaaacttcagcaatgaggagtggaaggaactggaaacattattccgtatacgcaccattcggtcatttgagggaattcgtagatacgcccatgaattgcagtttgaatatccttttgagatacaggtgacaggaggctgtgagctgcactctggaaaggtctcaggaagcttcttgcagttagcttatcaaggatcagactttgtgagcttccagaacaattcatggttgccatatccagtggctgggaatatggccaagcatttctgcaaagtgctcaatcagaatcagcatgaaaatgacataacacacaatcttctcagtgacacctgcccacgtttcatcttgggtcttcttgatgcaggaaaggcacatctccagcggcaagtgaagcccgaggcctggctgtcccatggccccagtcctggccctggccatctgcagcttgtgtgccatgtctcaggattctacccaaagcccgtgtgggtgatgtggatgcggggtgagcaggagcagcagggcactcagcgaggggacatcttgcccagtgctgatgggacatggtatctccgcgcaaccctggaggtggccgctggggaggcagctgacctgtcctgtcgggtgaagcacagcagtctagagggccaggacatcgtcctctactgggagcatcacagttccgtgggcttcatcatcttggcggtgatagtgcctttacttcttctgataggtcttgcgctttggttcaggaaacgctgtttctgttaagacacaccatgagcctcctcgtcacccttctccttttggggtgagagaccagcagcccaagggctccagacacacctgaacacatcgtgatgatgacgtcctctcaactctctttgtaaaaattttgttatttttgcttgtttctgattaatgattgtttgtcaatataagctcaatttaattttgcaggatttgttgttctgacctgggttctgggacttttaaattcaaattttatctccagatggaatggggtcctagcaacctccacatgttcaactattaatggatcatcaggcctgttttagatatcccttactccagagggccttccctgacttacaagtgggaagcagtctcttcctggtctgaactcccgccacattttagccgtactttgctaactgtgctcctcacttcctcttcttcattgcagttatttagatcccccctttccttctaatttttcagctccttcaatgcaaagtacatgtatttttaatatatgcatccctggtgaaggatcttgcctgcatgaaacatgttctcaataaaactctgtgttgaatttatgcc

SEQ ID NO: 450529 - DNA, 2039 bp, Homo sapiens
  misc_feature (683)..(683): n is a, c, g, or t
gggcagtcgtaggagactctgaaaaagcaaataaatcaatgttaaatcagaaatgtgaatgtagtaaggggctgaagagacaggggaagagaatacatgggaaaatattgaaaaggacagagtgatcaaaaagagcagggacatgggagcattgggcagcacactgggagccatttcactttatgctcttattgtatgattgagaaaaaaatgtccttagtggttaagtggcttttcaatgccacatcagacttgttccatagcagttgaattaggggaaggtgaataagttggaggttggtgacaaggagagaagctggaacagagaggagagtcagaaccagagggaaatgagagactgagtaggcatctcagggtttttgaaggagtggattttctttgttgcagtcaggggaggtttgtctgttggctgcagaaagaagtcagaatagagatatcgtggggtaggtttgtttggaacagaaatcaaagaccaatttttctgagagaaggaaataacatctgcaaatgatatgctgtttttgctacttccattgttagctgttctcccaggtgatggcaatgcagacgggctcaaggagcctctctccttccatgtcacctggatcgcatccttttacaaccattcctggaaacattccagcaccatcgttttcctgtgnccctggtccaggggaaacttcagcaatgaggagtggaaggaactggaaacattattccgtatacgcaccattcggtcatttgagggaattcgtagatacgcccatgaattgcagtttgaatatccttttgagatacaggtgacaggaggctgtgagctgcactctggaaaggtctcaggaagcttcttgcagttagcttatcaaggatcagactttgtgagcttccagaacaattcatggttgccatatccagtggctgggaatatggccaagcatttctgcaaagtgctcaatcagaatcagcatgaaaatgacataacacacaatcttctcagtgacacctgcccacgtttcatcttgggtcttcttgatgcaggaaaggcacatctccagcggcaagtgaagcccgaggcctggctgtcccatggccccagtcctggccctggccatctgcagcttgtgtgccatgtctcaggattctacccaaagcccgtgtgggtgatgtggatgcggggtgagcaggagcagcagggcactcagcgaggggacatcttgcccagtgctgatgggacatggtatctccgcgcaaccctggaggtggccgctggggaggcagctgacctgtcctgtcgggtgaagcacagcagtctagagggccaggacatcgtcctctactgggagcatcacagttccgtgggcttcatcatcttggcggtgatagtgcctttacttcttctgataggtcttgcgctttggttcaggaaacgctgtttctgttaagacacaccatgagcctcctcgtcacccttctccttttggggtgagagaccagcagcccaagggctccagacacacctgaacacatcgtgatgatgacgtcctctcaactctctttgtaaaaattttgttatttttgcttgtttctgattaatgattgtttgtcaatataagctcaatttaattttgcaggatttgttgttctgacctgggttctgggacttttaaattcaaattttatctccagatggaatggggtcctagcaacctccacatgttcaactattaatggatcatcaggcctgttttagatatcccttactccagagggccttccctgacttacaagtgggaagcagtctcttcctggtctgaactcccgccacattttagccgtactttgctaactgtgctcctcacttcctcttcttcattgcagttatttagatcccccctttccttctaatttttcagctccttcaatgcaaagtacatgtatttttaatatatgcatccctggtgaaggatcttgcctgcatgaaacatgttctcaataaaactctgtgttgaatttatgcc

SEQ ID NO: 450530 - DNA, 1418 bp, Homo sapiens
  misc_feature (683)..(683): n is a, c, g, or t
gggcagtcgtaggagactctgaaaaagcaaataaatcaatgttaaatcagaaatgtgaatgtagtaaggggctgaagagacaggggaagagaatacatgggaaaatattgaaaaggacagagtgatcaaaaagagcagggacatgggagcattgggcagcacactgggagccatttcactttatgctcttattgtatgattgagaaaaaaatgtccttagtggttaagtggcttttcaatgccacatcagacttgttccatagcagttgaattaggggaaggtgaataagttggaggttggtgacaaggagagaagctggaacagagaggagagtcagaaccagagggaaatgagagactgagtaggcatctcagggtttttgaaggagtggattttctttgttgcagtcaggggaggtttgtctgttggctgcagaaagaagtcagaatagagatatcgtggggtaggtttgtttggaacagaaatcaaagaccaatttttctgagagaaggaaataacatctgcaaatgatatgctgtttttgctacttccattgttagctgttctcccaggtgatggcaatgcagacgggctcaaggagcctctctccttccatgtcacctggatcgcatccttttacaaccattcctggaaacattccagcaccatcgttttcctgtgnccctggtccaggggaaacttcagcaatgaggagtggaaggaactggaaacattattccgtatacgcaccattcggtcatttgagggaattcgtagatacgcccatgaattgcagtttgaatatccttttgagatacaggtgacaggaggctgtgagctgcactctggaaaggtctcaggaagcttcttgcagttagcttatcaaggatcagactttgtgagcttccagaacaattcatggttgccatatccagtggctgggaatatggccaagcatttctgcaaagtgctcaatcagaatcagcatgaaaatgacataacacacaatcttctcagtgacacctgcccacgtttcatcttgggtcttcttgatgcaggaaaggcacatctccagcggcaagtgaagcccgaggcctggctgtcccatggccccagtcctggccctggccatctgcagcttgtgtgccatgtctcaggattctacccaaagcccgtgtgggtgatgtggatgcggggtgagcaggagcagcagggcactcagcgaggggacatcttgcccagtgctgatgggacatggtatctccgcgcaaccctggaggtggccgctggggaggcagctgacctgtcctgtcgggtgaagcacagcagtctagagggccaggacatcgtcctctactggggtgagaaaaagctaaggcccaggctggaaatgccaggaagtggacctcaggcatag

SEQ ID NO: 450531 - DNA, 1557 bp, Homo sapiens
  misc_feature (201)..(201): n is a, c, g, or t
cttcaatggggaaggaagaatttaggagccatgtttgcgtttggaggagcaacagggctcaaggagcctctctccttccatgtcacctggatcgcatccttttacaaccattcctggaaacaaaatctggtctcaggttggctgagtgatttgcagactcatacctgggacagcaattccagcaccatcgttttcctgtgnccctggtccaggggaaacttcagcaatgaggagtggaaggaactggaaacattattccgtatacgcaccattcggtcatttgagggaattcgtagatacgcccatgaattgcagtttgaatatccttttgagatacaggtgacaggaggctgtgagctgcactctggaaaggtctcaggaagcttcttgcagttagcttatcaaggatcagactttgtgagcttccagaacaattcatggttgccatatccagtggctgggaatatggccaagcatttctgcaaagtgctcaatcagaatcagcatgaaaatgacataacacacaatcttctcagtgacacctgcccacgtttcatcttgggtcttcttgatgcaggaaaggcacatctccagcggcaagtgaagcccgaggcctggctgtcccatggccccagtcctggccctggccatctgcagcttgtgtgccatgtctcaggattctacccaaagcccgtgtgggtgatgtggatgcggggtgagcaggagcagcagggcactcagcgaggggacatcttgcccagtgctgatgggacatggtatctccgcgcaaccctggaggtggccgctggggaggcagctgacctgtcctgtcgggtgaagcacagcagtctagagggccaggacatcgtcctctactgggagcatcacagttccgtgggcttcatcatcttggcggtgatagtgcctttacttcttctgataggtcttgcgctttggttcaggaaacgctgtttctgttaagacacaccatgagcctcctcgtcacccttctccttttggggtgagagaccagcagcccaagggctccagacacacctgaacacatcgtgatgatgacgtcctctcaactctctttgtaaaaattttgttatttttgcttgtttctgattaatgattgtttgtcaatataagctcaatttaattttgcaggatttgttgttctgacctgggttctgggacttttaaattcaaattttatctccagatggaatggggtcctagcaacctccacatgttcaactattaatggatcatcaggcctgttttagatatcccttactccagagggccttccctgacttacaagtgggaagcagtctcttcctggtctgaactcccgccacattttagccgtactttgctaactgtgctcctcacttcctcttcttcattgcagttatttagatcccccctttccttctaatttttcagctccttcaatgcaaagtacatgtatttttaatatatgcatccctggtgaaggatcttgcctgcatgaaacatgttctcaataaaactctgtgttgaatttatgcc

SEQ ID NO: 450532 - DNA, 1503 bp, Homo sapiens
  misc_feature (201)..(201): n is a, c, g, or t
cttcaatggggaaggaagaatttaggagccatgtttgcgtttggaggagcaacagggctcaaggagcctctctccttccatgtcacctggatcgcatccttttacaaccattcctggaaacaaaatctggtctcaggttggctgagtgatttgcagactcatacctgggacagcaattccagcaccatcgttttcctgtgnccctggtccaggggaaacttcagcaatgaggagtggaaggaactggaaacattattccgtatacgcaccattcggtcatttgagggaattcgtagatacgcccatgaattgcagtttgaatatccttttgagatacaggtgacaggaggctgtgagctgcactctggaaaggtctcaggaagcttcttgcagttagcttatcaaggatcagactttgtgagcttccagaacaattcatggttgccatatccagtggctgggaatatggccaagcatttctgcaaagtgctcaatcagaatcagcatgaaaatgacataacacacaatcttctcagtgacacctgcccacgtttcatcttgggtcttcttgatgcaggaaaggcacatctccagcggcaagtgaagcccgaggcctggctgtcccatggccccagtcctggccctggccatctgcagcttgtgtgccatgtctcaggattctacccaaagcccgtgtgggtgatgtggatgcggggtgagcaggagcagcagggcactcagcgaggggacatcttgcccagtgctgatgggacatggtatctccgcgcaaccctggaggtggccgctggggaggcagctgacctgtcctgtcgggtgaagcacagcagtctagagggccaggacatcgtcctctactgggagcatcacagttccgtgggcttcatcatcttggcggtgatagtgcctttacttcttctgataggtcttgcgctttggttcaggaaacgctgtttctgttaagacacaccatgagcctcctcgtcacccttctccttttggggtgagagaccagcagcccaagggctccagacacacctgaacacatcgtgatgatgacgtcctctcaactctctttgtatcaatttaattttgcaggatttgttgttctgacctgggttctgggacttttaaattcaaattttatctccagatggaatggggtcctagcaacctccacatgttcaactattaatggatcatcaggcctgttttagatatcccttactccagagggccttccctgacttacaagtgggaagcagtctcttcctggtctgaactcccgccacattttagccgtactttgctaactgtgctcctcacttcctcttcttcattgcagttatttagatcccccctttccttctaatttttcagctccttcaatgcaaagtacatgtatttttaatatatgcatccctggtgaaggatcttgcctgcatgaaacatgttctcaataaaactctgtgttgaatttatgcc

SEQ ID NO: 450533 - DNA, 1313 bp, Homo sapiens
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450534 - DNA, 348 bp, Homo sapiens
ggtaggaaaggaagaaattagaacaatgggagccttggctcccctctcgtctcctcccctccttcttgtcactggctttgatgaggcccacttcccagaggctcctgggcctgtgagtgcaggagctcattctcccctcacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450535 - DNA, 510 bp, Homo sapiens
gaacccgggaggcggagcttgcagtgacccgagatcacgccacgcactccagcctgggtgacagagtgagactccgtctaaaaaataaataaataaaagttagacacagtttagaggtacttgtgctgacctgaattcactgaaatgcttttcctacatcactttggggaaaggtgaatgtggagaattcagtgattctgttggaggaccttggggaggtcaatagatttctgtatgcttttatgcggcgggtcctttcccccctcgagtatggaacagatttcttgatttttctccccttcttcccagctggtgaaactggctaaacgcctcaagaaggagaaagtaaatgttgacattatcaattttggggaagaggtgagtagggactgattggagggcattgacttaatttggtcataaacagaatggtccttaaccctgaggagtgcgggtactgtgcagagtagtagtagcgcagcgggatcctctagactgacctcagcatca

SEQ ID NO: 450536 - DNA, 550 bp, Homo sapiens
atatcagtatatagagatcctgcggttcttctgatatggaagagcaggagggaggaggaggaggccggggaagtgagttctggtgtgaggcgggattgctacgagtgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaagggtgagacccaaccctgcccccatcaggtttaaagtccttgaatttagatcctcatccctctggggctgggagtatttctaccatagctaagtcctttgaggagcagagggaaacacatggatttgcatttcttacatgtaaaccttgctaaggtagcaatgctaatggtcagagttggagaaatgtcctcttgttctgtaattttcctttcttgctggtgggagcagcctggg

SEQ ID NO: 450537 - DNA, 1393 bp, Homo sapiens
aattcccaaatgaccttttatttcatacagagatacaaaggcaactatgtgcagcaacaatctgatgggcagtccaaactcttgggaggaagtaaattcatggtaaatgtcatgatgggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450538 - DNA, 1393 bp, Homo sapiens
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaacttttcttgccatatgcaatgcatatggcaaggccaaggtcagatagatgaccacgtgacgaaatagtaaaagctacctatagat

SEQ ID NO: 450539 - DNA, 1259 bp, Homo sapiens
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaagggtgagacccaaccctgcccccatcaggtttaaagtccttgaatttagatcctcatccctctggggctgggagtatttctaccatagctaagtcctttgaggagcagagggaaacacatggatttgcatttcttacatgtaaaccttgctaaggtagcaatgctaatggtcagagttggagaaatgtcctcttgttctgtaattttcctttcttgctggtgggagcagcctggg

SEQ ID NO: 450540 - DNA, 1293 bp, Homo sapiens
  misc_feature (22)..(23): n is a, c, g, or t
  misc_feature (25)..(27): n is a, c, g, or t
caatcggctggatgcatgcccnngnnnaatcggcgagggcagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450541 - DNA, 1509 bp, Homo sapiens
  misc_feature (1005)..(1005): n is a, c, g, or t
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagggtgaaagaggtggaatccgaagtcctgggactgcgggatgctaaacattgaaagctgggtgtaggcactgcagggagagtgtggaggtctgacagggtaggaatatgtgggagggctgggctaggaatggccttggaggctggcctgtgtggatatggcaccaattctaccctgctccncttttccttttcccagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450542 - DNA, 1252 bp, Homo sapiens
aattcccaaatgaccttttatttcatacagagatacaaaggcaactatgtgcagcaacaatctgatgggcagtccaaactcttgggaggaagtaaattcatggtaaatgtcatgatgggtcgggagggaggaaggtggcaagatggtgttggaaagcactatggtgtgtgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450543 - DNA, 1833 bp, Homo sapiens
aattcccaaatgaccttttatttcatacagagatacaaaggcaactatgtgcagcaacaatctgatgggcagtccaaactcttgggaggaagtaaattcatggtaaatgtcatgatgggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaagtatgggggacagaggaggaggggactcagtaggtgggtggttgttacatgctactcttctttagattccatgaagctgcttttgcccatcaccttcctagactgccttctgcactatttagtgtaaatgtcaatagcaacttgttttttgtattaacctgtatttaatgtagtacggaagctaaatctcctggggtgaaatttctgtttctttttattgtttgttgggcagggctagggtagggggtgaaatttcataatatattttaaagtcagtgaaaagtgattttgggctgggcacatgacccgagatcacgccacgcactccagcctgggtgacagagtgagactccgtctaaaaaataaataaataaaagttagacacagtttagaggtacttgtgctgacctgaattcactgaaatgcttttcctacatcactgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450544 - DNA, 1133 bp, Homo sapiens
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagcacatcagagcctgctgcaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450545 - DNA, 1639 bp, Homo sapiens
aattcccaaatgaccttttatttcatacagagatacaaaggcaactatgtgcagcaacaatctgatgggcagtccaaactcttgggaggaagtaaattcatggtaaatgtcatgatgggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatgtgagtccaagtggcagctggggaatgtggggagcccatgtttgggactgaggtcttccagccctcaggagaacctggcagaggcatcaggctcatcactttggggaaaggtgaatgtggagaattcagtgattctgttggaggaccttggggaggtcaatagatttctgtatgcttttatgcggcgggtcctttcccccctcgagtatggaacagatttcttgatttttctccccttcttcccagctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450546 - DNA, 1134 bp, Homo sapiens
ggttggctccgatggctgattgcgaagagccctatgtgctgctgtcactggtaacgtgctgaccacactcaccccagacactggccgtcttcttatcacagctcttctgtctcacacccatggtcaatcatatccttcttgtatggtctctcccgagtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450547 - DNA, 1019 bp, Homo sapiens
  misc_feature (827)..(827): n is a, c, g, or t
  misc_feature (830)..(830): n is a, c, g, or t
  misc_feature (840)..(840): n is a, c, g, or t
  misc_feature (842)..(842): n is a, c, g, or t
  misc_feature (849)..(849): n is a, c, g, or t
  misc_feature (852)..(852): n is a, c, g, or t
  misc_feature (854)..(854): n is a, c, g, or t
  misc_feature (857)..(858): n is a, c, g, or t
  misc_feature (862)..(862): n is a, c, g, or t
  misc_feature (869)..(869): n is a, c, g, or t
  misc_feature (885)..(886): n is a, c, g, or t
  misc_feature (890)..(890): n is a, c, g, or t
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagantcngacgatgccngntgaaatnacntngcnnaganttggcgntgggttctgaaccaanntatnggaaaaaatgtttcacgcgatcctccgggagaatgggccgggaaggacatggcctctgatcgcccgaggaaaatagggccgctctttcaaccggagaaaatttcccccgaagaaagaagtggtgtccaa

SEQ ID NO: 450548 - DNA, 1357 bp, Homo sapiens
aattcccaaatgaccttttatttcatacagagatacaaaggcaactatgtgcagcaacaatctgatgggcagtccaaactcttgggaggaagtaaattcatggtaaatgtcatgatgggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450549 - DNA, 1489 bp, Homo sapiens
  misc_feature (22)..(23): n is a, c, g, or t
  misc_feature (25)..(27): n is a, c, g, or t
  misc_feature (985)..(985): n is a, c, g, or t
caatcggctggatgcatgcccnngnnnaatcggcgagggcagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagggtgaaagaggtggaatccgaagtcctgggactgcgggatgctaaacattgaaagctgggtgtaggcactgcagggagagtgtggaggtctgacagggtaggaatatgtgggagggctgggctaggaatggccttggaggctggcctgtgtggatatggcaccaattctaccctgctccncttttccttttcccagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450550 - DNA, 838 bp, Homo sapiens
aattcccaaatgaccttttatttcatacagagatacaaaggcaactatgtgcagcaacaatctgatgggcagtccaaactcttgggaggaagtaaattcatggtaaatgtcatgatgggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450551 - DNA, 1150 bp, Homo sapiens
aattcccaaatgaccttttatttcatacagagatacaaaggcaactatgtgcagcaacaatctgatgggcagtccaaactcttgggaggaagtaaattcatggtaaatgtcatgatgggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaagtatgggggacagaggaggaggggactcagtaggtgggtggttgttacatgctactcttctttagattccatgaagctgcttttgcccatcaccttcctagactgccttctgcactatttagtgtaaatgtcaatagcaacttgttttttgtattaacctgtatttaatgtagtacggaagctaaatctcctggggtgaaatttctgtttctttttattgtttgttgggcagggctagggtagggggtgaaatttcataatatattttaaagtcagtgaaaagtgattttgggctgggcacagtggctcatgtctgtaatcccaagagtttgagaccagcctgggcaacaggacaaaaccctgtctctactaaaaatacaaaaattagccaggcatggtggtggctacctgtaataccagctactcaggaggctgaggcaggagaatcgcttgaactcgggaggcggaggttgcagtgagccaagatcacaccactgcacaccagcttgggcgacagaatgagactccatttcaaaaaaaaagaaaaaagtaatttttggatcagagcccctgggcatatatcactcatccttttaccctgaaagtgttttgttttaggaactgataattcttaaatgagtagcctcccactccagtgtacatactgttagctaggagaatgggtctggaggtggagaggacaggagagatacaaattagcatcgttattttggtggattctcagggccctgtgagcctttaaaaggagttaggggaaaatatttggaagtagagggcagctttcttacaaagccagccacttaattatttctgtgcttgg

SEQ ID NO: 450552 - DNA, 329 bp, Homo sapiens
ctgaagatgaccatcagccagcaagagtttggccgcactgggcttcctgacctaagcagtatgactgaggaagagcagattgcttatgccatgcagatgtccctgcagggagcaggtgagccagagcctgggtggtgcctaggcagaggttggggtgaggaagtgtaactgaacagactgacctctcttcctcagagtttggccaggcggaatcagcagacattgatgccagctcagctatggacacatccgagccagccaagggtgagacccaaccctgcccccatcaggtttaaagtccttgaatttagatcctcatccctctgggg

SEQ ID NO: 450553 - DNA, 903 bp, Homo sapiens
  misc_feature (65)..(65): n is a, c, g, or t
  misc_feature (74)..(74): n is a, c, g, or t
  misc_feature (81)..(81): n is a, c, g, or t
  misc_feature (829)..(830): n is a, c, g, or t
  misc_feature (838)..(838): n is a, c, g, or t
acaaacaccaccacaccacccccacacccccctacgtctagcagcactgcctgcttaactcgtanaggctgtgngaagcantatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaganncagagatncctgctgaaataaccatagagcaagattgcgcatgggtccgactaacactatactggaccgaagg

SEQ ID NO: 450554 - DNA, 1693 bp, Homo sapiens
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaacttttaaaaaaaaaaaacaaccaaacaaaaacaaacaaaaaacaattggtggggcgcggcgccttggggcccctggagaaaggttttcttgacaaccacttccggtgggggcggcggggggcccagattggtgacaggggccatggggccaaaagcggggtcccacaagggggaactctggggcaaacagaaaaggggggggggggttttcaccccaattaaaaaacgcgccgggggggaacacacaggggtgttcttagaaaaaattcccaaagaggaagaggtaccaggaggagcaaaaacggggagactcttcaaacagggggggtccaaaaggggagtactcgaactacaaaattaaccccccggcgccgtgtggggacga

SEQ ID NO: 450555 - DNA, 1367 bp, Homo sapiens
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaacttttcttgccatatgcaacaggccaagaagtacatggaggagcaatgaccagcgcaag

SEQ ID NO: 450556 - DNA, 1553 bp, Homo sapiens
aattcccaaatgaccttttatttcatacagagatacaaaggcaactatgtgcagcaacaatctgatgggcagtccaaactcttgggaggaagtaaattcatggtaaatgtcatgatgggtcgggagggaggaaggtggcaagatggtgttggaaagcactatggtgtgaaattagctggcatggtggtgcacgcctgtggtcccagctacccgggaagctgaagtgggaagatctattgagcctgggaggttgaggctacagtgagctgtgactgcgcttgaacctgtgcctgcgcttgaacctgtgcctgaatactaccctagacagtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450557 - DNA, 1193 bp, Homo sapiens
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcacagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450558 - DNA, 1158 bp, Homo sapiens
tacggctaggagcgaggacagggcgtgtgaacttcggtgaggagggatcacagctggtctaatgacaggtaaggtgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450559 - DNA, 1551 bp, Homo sapiens
aattcccaaatgaccttttatttcatacagagatacaaaggcaactatgtgcagcaacaatctgatgggcagtccaaactcttgggaggaagtaaattcatggtaaatgtcatgatgggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggtgagtagggactgattggagggcattgacttaatttggtcataaacagaatggtccttaaccctgaggagtgcgggtactgtgcagagtagtgcagaaatgggaaagaacagggagcaaggcctgaagaagggcatcatgtgttctttcctccccaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450560 - DNA, 1037 bp, Homo sapiens
  misc_feature (22)..(23): n is a, c, g, or t
  misc_feature (25)..(27): n is a, c, g, or t
caatcggctggatgcatgcccnngnnnaatcggcgagggcagatggtgttggaaagcactatggtgtgctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450561 - DNA, 1037 bp, Homo sapiens
ggctaggtcaggccggtgtgaatcggacgagggggcagatcccttctgacgggcatccgcgtggccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450562 - DNA, 1797 bp, Homo sapiens
aattcccaaatgaccttttatttcatacagagatacaaaggcaactatgtgcagcaacaatctgatgggcagtccaaactcttgggaggaagtaaattcatggtaaatgtcatgatgggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatgtgagtccaagtggcagctggggaatgtggggagcccatgtttgggactgaggtcttccagccctcaggagaacctggcagaggcatcaggctcatcactttggggaaaggtgaatgtggagaattcagtgattctgttggaggaccttggggaggtcaatagatttctgtatgcttttatgcggcgggtcctttcccccctcgagtatggaacagatttcttgatttttctccccttcttcccagctggtgaaactggctaaacgcctcaagaaggagaaagtaaatgttgacattatcaattttggggaagaggtgagtagggactgattggagggcattgacttaatttggtcataaacagaatggtccttaaccctgaggagtgcgggtactgtgcagagtagtgcagaaatgggaaagaacagggagcaaggcctgaagaagggcatcatgtgttctttcctccccaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450563 - DNA, 900 bp, Homo sapiens
  misc_feature (28)..(28): n is a, c, g, or t
  misc_feature (31)..(31): n is a, c, g, or t
  misc_feature (56)..(56): n is a, c, g, or t
  misc_feature (58)..(58): n is a, c, g, or t
  misc_feature (82)..(82): n is a, c, g, or t
  misc_feature (86)..(86): n is a, c, g, or t
tggggtcccacgtagcaacaagcttctnccntgatgtcgcgcacgatctcgggaantncccgttgacattatcaatttgggnaagnggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450564 - DNA, 912 bp, Homo sapiens
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgagaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 450565 - DNA, 586 bp, Homo sapiens
aattcccaaatgaccttttatttcatacagagatacaaaggcaactatgtgcagcaacaatctgatgggcagtccaaactcttgggaggaagtaaattcatggtaaatgtcatgatgggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggaaggttgtacaggaaggttggtagagtacaggaagtgtctaggg

SEQ ID NO: 450566 - DNA, 820 bp, Homo sapiens
gcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcagcaaaaaaaaaaaaaaaaaaaaaaaaaacaaaaaaactgtgaggggatctctaaattgcgggggggcggaaaaaacggggtataggaaaggggccatttggggtcatataggttggttccttaggaccccggttttttttgcaccaagggtggaaaaattggcggggcccccaataaggaggggcggataaatttcgaaaaacgccggttacccggtagagggggaat

SEQ ID NO: 450567 - DNA, 939 bp, Homo sapiens
tcggtaccgacgacaggcgacccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaaaaaaaaaagcgcagagggcgtccgaggagtgtggcggaaggacctcgtggagggatttactgatgcaagagatccggaaggttcatcaaggcttttaagaaagttgggtctccctctggaaagggtggagtgcatagcacgtgatgctgacctggaaatagtcgggggggcagatctgaagcgctgggtggactggatccacacacaaggttgtgtcagcaaggcggaatcgaagagcgtgaagaaatgcgggggtaaggaccgggacaggcggccacaacaaggatccgggtccggtcaggaaccttccgtgggggggtggaagggtcaaccaccgggccgaaaaaaatgcttcggggccggcactagcggagggggacaaaccagggataccaggaacggcaccctatacaccggaactactg

SEQ ID NO: 450568 - DNA, 1015 bp, Homo sapiens
ttcaattcctcatgacagattgcagcttccttcattagcaatttgataaatgggatgccttcctctaagcccttgagagattgccagaaatgccccgccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaaaaaaaaaagcgcagagggcgtccgaggagtgtggcggaaggacctcgtggagggatttactgatgcaagagatccggaaggttcatcaaggcttttaagaaagttgggtctccctctggaaagggtggagtgcatagcacgtgatgctgacctggaaatagtcgggggggcagatctgaagcgctgggtggactggatccacacacaaggttgtgtcagcaaggcggaatcgaagagcgtgaagaaatgcgggggtaaggaccgggacaggcggccacaacaaggatccgggtccggtcaggaaccttccgtgggggggtggaagggtcaaccaccgggccgaaaaaaatgcttcggggccggcactagcggagggggacaaaccagggataccaggaacggcaccctatacaccggaactactg

SEQ ID NO: 450569 - DNA, 596 bp, Homo sapiens
gcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggccgggctgagctggaggagctgaggtccctggggccagcaggtgatagaagctgaggtgtggattgagaacttcagagtaatacaggccaggtgcggtaatacaggccagcacttcggaaggccagggtgggcagattgcttgaggtcaggagtttgagacca

SEQ ID NO: 450570 - DNA, 838 bp, Homo sapiens
aggtgaaatcacaaaggatcagtggagtttgaggattatctagttcaatgctttgagtttagagttttacggtgaaaatgagacttgtctcctgacactaagtctctctcaactatagcgctatcttgctattttctctatctcagaaggatccttgggcaggaggaaggatgtggatatgatttggctggtttctatgctgaagctcttatctgattttctctcacagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaaaaaaaaaagcgcagagggcgtccgaggagtgtggcggaaggacctcgtggagggatttactgatgcaagagatccggaaggttcatcaaggcttttaagaaagttgggtctccctctggaaagggtggagtgcatagcacgtgatgctgacctggaaatagtcgggggggcagatctgaagcgctgggtggactggatccacacacaaggttgtgtcagcaaggcggaatcgaagagcgtgaagaaatgcgggggtaaggaccgggacaggcggccacaacaaggatccgggtccggtcaggaaccttccgtgggggggtggaagggtcaaccaccgggccgaaaaaaatgcttcggggccggcactagcggagggggacaaaccagggataccaggaacggcaccctatacaccggaactactg

SEQ ID NO: 450571 - DNA, 270 bp, Homo sapiens
agtcatctctctcattaacaatgttttttgtcttagaaatttcttgttgatttttaaacttacatgatttcttgttttggtatgaatacaggctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaact

SEQ ID NO: 450572 - DNA, 1020 bp, Homo sapiens
gcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaaaaaaaaaagcgcagagggcgtccgaggagtgtggcggaaggacctcgtggagggatttactgatgcaagagatccggaaggttcatcaaggcttttaagaaagttgggtctccctctggaaagggtggagtgcatagcacgtgatgctgacctggaaatagtcgggggggcagatctgaagcgctgggtggactggatccacacacaaggttgtgtcagcaaggcggaatcgaagagcgtgaagaaatgcgggggtaaggaccgggacaggcggccacaacaaggatccgggtccggtcaggaaccttccgtgggggggtggaagggtcaaccaccgggccgaaaaaaatgcttcggggccggcactagcggagggggacaaaccagggataccaggaacggcaccctatacaccggaactactg

SEQ ID NO: 450573 - DNA, 1223 bp, Homo sapiens
aaagagggaacttcagatgagaggagggagaaatcctggagaggtgatccttaaacggtggctggaatttccgcaggaggccatggaagactttacaggccactggatggcgccgggagcactgatttggagctgggtcctagagccttcgcaggccgttggcatctggcacttgggctgcagagcctgtcctcccttaattccccgactctggcagccccaccaccgaagtctacaagctgcttctgttcccatgcagtggccccatagtcctggatttgaagaccagccctgctacttaccagccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaaaaaaaaaagcgcagagggcgtccgaggagtgtggcggaaggacctcgtggagggatttactgatgcaagagatccggaaggttcatcaaggcttttaagaaagttgggtctccctctggaaagggtggagtgcatagcacgtgatgctgacctggaaatagtcgggggggcagatctgaagcgctgggtggactggatccacacacaaggttgtgtcagcaaggcggaatcgaagagcgtgaagaaatgcgggggtaaggaccgggacaggcggccacaacaaggatccgggtccggtcaggaaccttccgtgggggggtggaagggtcaaccaccgggccgaaaaaaatgcttcggggccggcactagcggagggggacaaaccagggataccaggaacggcaccctatacaccggaactactg

SEQ ID NO: 450574 - DNA, 504 bp, Homo sapiens
gcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggctgcttcagtccttcaataagcccatcacactttttcaccatgtcatctatcagcactttttctgcagtgttacgaacatcagcttcatcac

SEQ ID NO: 450575 - DNA, 559 bp, Homo sapiens
gcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaggggtacaggagcactgggggttttgcggttccaaaggtgtgtacagctgtgtgtgtctgtgtaatggaggcccagggagagcaggaccaggcaagtgtgtgtggggtgtggtgtgtgtgcttttaggcagggcaccgtgggctttgaggagtgtttctgagagattcgag

SEQ ID NO: 450576 - DNA, 3872 bp, Homo sapiens
aaaagcagaatctgtgagtcgcctggaggcagcgcggcggctgccgtgaggaggccgggtgcggagccgccggtggcccagccgctcagggccagggcctgggctgggagggagagaccggagcagcgccaggagcccgaggccggagccgaggaggaatgtgaccaggggtcggcgggggcgcgggagtacgcgagagcagggatggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatgatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaa

SEQ ID NO: 450577 - DNA, 3572 bp, Homo sapiens
ctgggcagaggtatggtccttgggacagttctccttccacctaatagttatggcagagatcaggacacttcactttgctgcctgtgcactgaggcctcagaatctgctctacccgacttaacagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaa

SEQ ID NO: 450578 - DNA, 541 bp, Homo sapiens
ctgggcagaggtatggtccttgggacagttctccttccacctaatagttatggcagagatcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaa

SEQ ID NO: 450579 - DNA, 3141 bp, Homo sapiens
ctgggcagaggtatggtccttgggacagttctccttccacctaatagttatggcagagatcaggacacttcactttgctgcctgtgcactgaggcctcagaatctgctctacccgacttaacagatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacggggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaa

SEQ ID NO: 450580 - DNA, 114 bp, Homo sapiens
ttttaatattttttcttctgttacataggctggaagtggagccctgccgataggccctcttttgctgaaacacaccaagcttttgaaaccatgttccatgactccagcatttct

SEQ ID NO: 450581 - DNA, 3450 bp, Homo sapiens
ctgggcagaggtatggtccttgggacagttctccttccacctaatagttatggcagagatcaggacacttcactttgctgcctgtgcactgaggcctcagaatctgctctacccgacttaacagatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaa

SEQ ID NO: 450582 - DNA, 519 bp, Homo sapiens
tcacaaagacccaagcttcctccagcttccaggatagcagtcagccagctggaaaaaaaaaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaaggtccgtgaaactaagagctgtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctgaaaaaaaaaa

SEQ ID NO: 450583 - DNA, 2717 bp, Homo sapiens
aggaagaggcggggccgcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctgaaaaaaaaaa

SEQ ID NO: 450584 - DNA, 2816 bp, Homo sapiens
aggaagaggcggggccgcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatatccttgcagggcagagtgaagagttaggaggaaggtggttgggagagggatttccaggccttaggacatcatgacacagttccttaacaggcccacatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctgaaaaaaaaaa

SEQ ID NO: 450585 - DNA, 2965 bp, Homo sapiens
aggaagaggcggggccgcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggtgaggagtcaggtggtgggcccctgagaggccttggctgggtctcgtagagctggaaactgagatggggacaccctctgggctcccctctcctcctgaggctgcctttgggtctctttttgggacaggatgagaaggacatcctgcgctgtgctcacctccagaaggagttgctcctgagtgctattgactctgtcaatgcgacctccaagacaggaggctacctggtttactgcacctgttctatcacagtgagacctctgccatggcagagcaggggaggctgggctggggggctctttgccccttagagctcccttcagctccagctctgctttttcctccgttctttgtcttccccccacatccaggtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctgaaaaaaaaaa

SEQ ID NO: 450586 - DNA, 1429 bp, Homo sapiens
aggaagaggcggggccgcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctgaaaaaaaaaa

SEQ ID NO: 450587 - DNA, 2252 bp, Homo sapiens
aggaagaggcggggccgcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacgccattgtcaccaggttggaactcttgcctctgtgaggatgccttctctactgtgcatacccatgaaatttaatacacattttaaaacctctgaaaaaaaaaa

SEQ ID NO: 450588 - DNA, 568 bp, Homo sapiens
aggaagaggcggggccgcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgccgccattgtcaccaggttggaactcttgcctctgtgaggatgccttctctactgtgcatacccatgaaatttaatacacattttaaaacctctgaaaaaaaaaa

SEQ ID NO: 450589 - DNA, 147 bp, Homo sapiens
ttcttccggttgaccttctcccttcctgacctcaatgtttagactcgaccctagtaaatattgccctgctggttgcagaagagacatatgattcatctgtatcttttctccaggtggtggggggctttgaccgagtactgctggatg

SEQ ID NO: 450590 - DNA, 431 bp, Homo sapiens
aaataagtctcctgaggccaaaccattgcctggaaagctaccaaaaggtccgtgaaactaagagctggatgctacatgaggagtccctttgggtcctgggtagggaagaactcgctaaacatttccggagtgaaaggaacagccaaaggacattctgaggggtagaaagtacaggctcccagggtgtggggccagggaatgtgtggctgccattagtccaggactcttcaaacccttagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgact

SEQ ID NO: 450591 - DNA, 2615 bp, Homo sapiens
cacgcgcgacgccaccttctcccatttctgcctgccacagtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctgaaaaaaaaaa

SEQ ID NO: 450592 - DNA, 2785 bp, Homo sapiens
aggaagaggcggggccgcgaggctagcgctacccgtgcgcctgcgtggaacgattctgtggcgagtgccggccgaaagctaggtccggattgcacgtggagggccgcccgaagggcactctcggacattaacccgcattctggtgggtctagaggaaattgggggacgaagagtggcagcactgacctggtctgggacgtggggagaaggtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctgaaaaaaaaaa

SEQ ID NO: 450593 - DNA, 2837 bp, Homo sapiens
aggaagaggcggggccgcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtgagacctctgccatggcagagcaggggaggctgggctggggggctctttgccccttagagctcccttcagctccagctctgctttttcctccgttctttgtcttccccccacatccaggtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctgaaaaaaaaaa

SEQ ID NO: 450594 - DNA, 2176 bp, Homo sapiens
agaaagtattagaggcgataccggtttgttatttacgtgagggggctggggtttgattgatattactgtgggttaggcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctgaaaaaaaaaa

SEQ ID NO: 450595 - DNA, 854 bp, Homo sapiens
aggaagaggcggggccgcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatggacgagctcccctggatggacgagctcccctggatggacgagctcccctggatggacgagct

SEQ ID NO: 450596 - DNA, 522 bp, Homo sapiens
aggaagaggcggggccgcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctctgtgaggatgccttctctactgtgcatacccatgaaatttaatacacattttaaaacctctgaaaaaaaaaa

SEQ ID NO: 450597 - DNA, 771 bp, Homo sapiens
  misc_feature (1)..(1): n is a, c, g, or t
  misc_feature (4)..(4): n is a, c, g, or t
  misc_feature (6)..(9): n is a, c, g, or t
ngcncnnnngttacagatacggaaacaggctcggaggtgcaatctctggctgtgtagacagaacagggagttggaacacggccttctgcgtttcctcactctcacataccagcgggcagggagagatccggggaggagttgcacttgcccccggcggaaatctccaaaaatctgcaaaaatgtattccctggtaccgctttgggctccggtgggaccaagcgaaattccgagaccgaaacggatgcgcgctgcggcccagggtgcgggtctggaccgcctcctccgtggtggacgaatccgaggagcaggactccccgcaacccagccccagccccagccccagccccgccgcgtccccagctgtcacgctgcgcgcagcgggtggggcctggggttcctggacagaggaggactacgcgtgtccttgggcggagaagggaggtgactccggcggaagaggacaaggcagaatgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctg

SEQ ID NO: 450598 - DNA, 894 bp, Homo sapiens
  misc_feature (1)..(1): n is a, c, g, or t
  misc_feature (4)..(4): n is a, c, g, or t
  misc_feature (6)..(9): n is a, c, g, or t
ngcncnnnngttacagatacggaaacaggctcggaggtgcaatctctggctgtgtagacagaacagggagttggaacacggccttctgcgtttcctcactctcacataccagcgggcagggagagatccggggaggagttgcacttgcccccggcggaaatctccaaaaatctgcaaaaatgtattccctggtaccgctttgggctccggtgggaccaagcgaaattccgagaccgaaacggatgcgcgctgcggcccagggtgcgggtctggaccgcctcctccgtggtggacgaatccgaggagcaggactccccgcaacccagccccagccccagccccagccccgccgcgtccccagctgtcacgctgcgcgcagcgggtggggcctggggttcctggacagaggaggactacgcgtgtccttgggcggagaagggaggtgactccggcggaagaggacaaggcagaatgcaggcccttcgggtgtcccaggcgctgatccgctccttcagctccaccgcccggaaccgctttcagaaccgagtgcgcgagaaacagaagctcttccaggtggggggggcggggggggtggggatccgacgcgccagccgggagcgcgccgagccggggcaggcggggcgcgctctaaggagcagccagcacccctttctcatcagacacccccacatccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctg

SEQ ID NO: 450599 - DNA, 1025 bp, Homo sapiens
  misc_feature (1)..(1): n is a, c, g, or t
  misc_feature (4)..(4): n is a, c, g, or t
  misc_feature (6)..(9): n is a, c, g, or t
ngcncnnnngttacagatacggaaacaggctcggaggtgcaatctctggctgtgtagacagaacagggagttggaacacggccttctgcgtttcctcactctcacataccagcgggcagggagagatccggggaggagttgcacttgcccccggcggaaatctccaaaaatctgcaaaaatgtattccctggtaccgctttgggctccggtgggaccaagcgaaattccgagaccgaaacggatgcgcgctgcggcccagggtgcgggtctggaccgcctcctccgtggtggacgaatccgaggagcaggactccccgcaacccagccccagccccagccccagccccgccgcgtccccagctgtcacgctgcgcgcagcgggtggggcctggggttcctggacagaggaggactacgcgtgtccttgggcggagaagggaggtgactccggcggaagaggacaaggcagaatgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctgaaaaaaaaaaaaaaaaaaaaaaaaaaaaaacacttgtgttgggcgggcgccctcggcccccgaaaaaagtttttaaaccccctcgtgtgtggggcgccggcgggccccattggtgttaggttgaaccctgtggcccaagaggggtcccagggaagaacccgggcccaggcactggggctcggggtttctcccccaaaaaaaaacgccgggggggacaccgccggcggttctggaaccaccccggatggggttgc

SEQ ID NO: 450600 - DNA, 752 bp, Homo sapiens
  misc_feature (1)..(1): n is a, c, g, or t
  misc_feature (4)..(4): n is a, c, g, or t
  misc_feature (6)..(9): n is a, c, g, or t
ngcncnnnngttacagatacggaaacaggctcggaggtgcaatctctggctgtgtagacagaacagggagttggaacacggccttctgcgtttcctcactctcacataccagcgggcagggagagatccggggaggagttgcacttgcccccggcggaaatctccaaaaatctgcaaaaatgtattccctggtaccgctttgggctccggtgggaccaagcgaaattccgagaccgaaacggatgcgcgctgcggcccagggtgcgggtctggaccgcctcctccgtggtggacgaatccgaggagcaggactccccgcaacccagccccagccccagccccagccccgccgcgtccccagctgtcacgctgcgcgcagcgggtggggcctggggttcctggacagaggaggactacgcgtgtccttgggcggagaagggaggtgactccggcggaagaggacaaggcagaatgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcctttgctggcctacttcgcaagaattagacaagagactgcgagctaagatatatacagtctaataacgtggc

SEQ ID NO: 450601 - DNA, 271 bp, Homo sapiens
cagggggctttacaataggagtccaatctgggaagggagctggagtccgaactagagctggggtccaggctgggaaccagggagcctgaaggccttaaaagcctgggatgtccagggaggggattaggtctcattctgtctccaacgcttcccctttctaggcactgtctacagcttgtactcccttggctgggcctccttccccaggaactcccccaacaagattaggggttcttagggactttttttagtttcaataacagctatcacc

SEQ ID NO: 450602 - DNA, 407 bp, Homo sapiens
ttaggccccccagaacaaagtccttctgggtcctctcccttccgggaccctctaggcagcccggtcacccccaggccagactccagggcgagtcccctcccaacccagctggcagttcgcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctg

SEQ ID NO: 450603 - DNA, 956 bp, Homo sapiens
  misc_feature (1)..(1): n is a, c, g, or t
  misc_feature (4)..(4): n is a, c, g, or t
  misc_feature (6)..(9): n is a, c, g, or t
ngcncnnnngttacagatacggaaacaggctcggaggtgcaatctctggctgtgtagacagaacagggagttggaacacggccttctgcgtttcctcactctcacataccagcgggcagggagagatccggggaggagttgcacttgcccccggcggaaatctccaaaaatctgcaaaaatgtattccctggtaccgctttgggctccggtgggaccaagcgaaattccgagaccgaaacggatgcgcgctgcggcccagggtgcgggtctggaccgcctcctccgtggtggacgaatccgaggagcaggactccccgcaacccagccccagccccagccccagccccgccgcgtccccagctgtcacgctgcgcgcagcgggtggggcctggggttcctggacagaggaggactacgcgtgtccttgggcggagaagggaggtgactccggcggaagaggacaaggcagaatgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccaggagaaactggagcaggccgagaagaaggccactgatgctgaaggcagatgtggcctccctgaaccggcgcattcagcttggttgagggaggagctggaccgggcccagggagccgcctgggttacaggcccttgcagaagctggaggaggccgagaaggcggctgatgagagcgagagaggacatgaaggtcactcgaaaaaccggggccatgcaggactgaggagaaagatggaactgcaggagatgcaggctgaaggaggccaagcacat

SEQ ID NO: 450604 - DNA, 744 bp, Homo sapiens
  misc_feature (1)..(1): n is a, c, g, or t
  misc_feature (4)..(4): n is a, c, g, or t
  misc_feature (6)..(9): n is a, c, g, or t
ngcncnnnngttacagatacggaaacaggctcggaggtgcaatctctggctgtgtagacagaacagggagttggaacacggccttctgcgtttcctcactctcacataccagcgggcagggagagatccggggaggagttgcacttgcccccggcggaaatctccaaaaatctgcaaaaatgtattccctggtaccgctttgggctccggtgggaccaagcgaaattccgagaccgaaacggatgcgcgctgcggcccagggtgcgggtctggaccgcctcctccgtggtggacgaatccgaggagcaggactccccgcaacccagccccagccccagccccagccccgccgcgtccccagctgtcacgctgcgcgcagcgggtggggcctggggttcctggacagaggaggactacgcgtgtccttgggcggagaagggaggtgactccggcggaagaggacaaggcagaatgcaggcccttcgggtgtcccaggcgctgatccgctccttcagctccaccgcccggaaccgctttcagaaccgagaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctg

SEQ ID NO: 450605 - DNA, 335 bp, Homo sapiens
ccaccgtgcccagtgcatttttattttcataaaaatatctctgtacagtaccaatccttcttacactgtctgcttcagtttcagtgcctgtatcatagaagtgtccatgttgtaaaagaaatcaaaagcagtcttgaataattggaacccaccttctggattgtctaatgtcagtttgttgtctgggcactgcttcttctgtcttcttcctcactgtctaacactggttcagaaacactcatctccatcaagtaggcttcagttgatttcctcaggtgtggtgtctgttcgctcttgaattcctgcaacatccatatcttgaaactttttgccct

SEQ ID NO: 450606 - DNA, 3702 bp, Homo sapiens
cgcggtggcaagtcgaaagcgttcgcaccagcggggcagcggctgcgggcggcaggcggcgggcaggtcgggagtgagaaggaccggcctgggctgactgctctcccctcgcgcctagggagccggtcggagagcgcgattggggtgcggagccccgacgctgccctgccccggatttcattccgcggcgggggctccgcgagcggaattccggcggctgccgtgactccagtgcaacgtgacgacagcatgtacgatccctgaatgggcccgtgggcatatttagtcattcatttttgatcaggagaaagaagacagccatcatttgaaaggtaaagcttcagcgactgaaggagtgtggactttttgaatttcaagaacagtaaagttggaacacagcagagggtgtgtaataaaatacagattggaaagaagactgatgaagaaaaataacagcatgattcaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcaggtgatggaactgtactggaacaatgggagaagctggtagcttataggaagccaagatgaccagaatgtttttaaataatccaaggaagaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtctattattagcagaagatttttctgcatagttggcacgctgtacctgtatcggtgtattacaatgtatgtaactacactcccagtacctggtatgcatttcaactgttctccgaagcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcatgcactgtacacatttcctgttcataagtttgggatttacataacccgcaaccaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaacaccaaatttaaagatttttaacatgtcagagagaagagagttaaaatttaaaaatgcatcttgggagagaaatttgtctatgtttctagtgcctttcttgtcttgattgtatggtcagtaggcaatcttaaatgtttttatttaaaataaagtattccttgaaaatataaatatatgtatacactactaaattttgcatttatagctaaattgaatcagaagactgcttatggttttaaaattgcaatgacttaaataatgaggttgttaattagagtcagagcctgttcacatattgtgatcaggtagcaatgacatgtaccacttaaattattttatcgtcgatttggtagttcgattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaactctaagttttactcctaacatacatatgtttggggaagtattctattctatacttgccaatgtggagaacaaaatagttttttaagaatgaagaagtatatatatccattctgtattttacgtgcagcagaattatcttccgtaggatttttttgtgtattcacaaggtgatatttgtattgtaaaacaataatggtgaaggaaataaaaaggcttttaaaattttgtttgttttaaatctttgtaaagttattattccagagagtatactggtatcttacagcttacctagatcataaattaatcaaaatgcactttttaataaaaactgatacttaaaata

SEQ ID NO: 450607 - DNA, 3111 bp, Homo sapiens
tactatgcattaggctctagagattccaaagcaaatgaaaggacaaaggaaggtataaggtaggaagaatattccaggcagaaggaacaacttgcaagaaggaagaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtctattattagcagaagatttttctgcatagttggcacgctgtacctgtatcggtgtattacaatgtatgtaactacactcccagtacctggtatgcatttcaactgttctccgaagcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcatgcactgtacacatttcctgttcataagtttgggatttacataacccgcaaccaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaacaccaaatttaaagatttttaacatgtcagagagaagagagttaaaatttaaaaatgcatcttgggagagaaatttgtctatgtttctagtgcctttcttgtcttgattgtatggtcagtaggcaatcttaaatgtttttatttaaaataaagtattccttgaaaatataaatatatgtatacactactaaattttgcatttatagctaaattgaatcagaagactgcttatggttttaaaattgcaatgacttaaataatgaggttgttaattagagtcagagcctgttcacatattgtgatcaggtagcaatgacatgtaccacttaaattattttatcgtcgatttggtagttcgattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaactctaagttttactcctaacatacatatgtttggggaagtattctattctatacttgccaatgtggagaacaaaatagttttttaagaatgaagaagtatatatatccattctgtattttacgtgcagcagaattatcttccgtaggatttttttgtgtattcacaaggtgatatttgtattgtaaaacaataatggtgaaggaaataaaaaggcttttaaaattttgtttgttttaaatctttgtaaagttattattccagagagtatactggtatcttacagcttacctagatcataaattaatcaaaatgcactttttaataaaaactgatacttaaaata

SEQ ID NO: 450608 - DNA, 3473 bp, Homo sapiens
ctaggcctgctgtgtaccacatcttgggatcctctctttaacacctttctgggcatttcttatatcttgcctatgtattggattcccagtttccctcattgcatattctcttctttcttggtttactcccgtatttgggaggagcacattttctggaagtgtcctagaaaatttcatatgggaggtaaagcttcagcgactgaaggagtgtggactttttgaatttcaagaacagtaaagttggaacacagcagagggtgtgtaataaaatacagattggaaagaagactgatgaagaaaaataacagcatgattcaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcagaaggaagaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtctattattagcagaagatttttctgcatagttggcacgctgtacctgtatcggtgtattacaatgtatgtaactacactcccagtacctggtatgcatttcaactgttctccgaagcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcatgcactgtacacatttcctgttcataagtttgggatttacataacccgcaaccaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaacaccaaatttaaagatttttaacatgtcagagagaagagagttaaaatttaaaaatgcatcttgggagagaaatttgtctatgtttctagtgcctttcttgtcttgattgtatggtcagtaggcaatcttaaatgtttttatttaaaataaagtattccttgaaaatataaatatatgtatacactactaaattttgcatttatagctaaattgaatcagaagactgcttatggttttaaaattgcaatgacttaaataatgaggttgttaattagagtcagagcctgttcacatattgtgatcaggtagcaatgacatgtaccacttaaattattttatcgtcgatttggtagttcgattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaactctaagttttactcctaacatacatatgtttggggaagtattctattctatacttgccaatgtggagaacaaaatagttttttaagaatgaagaagtatatatatccattctgtattttacgtgcagcagaattatcttccgtaggatttttttgtgtattcacaaggtgatatttgtattgtaaaacaataatggtgaaggaaataaaaaggcttttaaaattttgtttgttttaaatctttgtaaagttattattccagagagtatactggtatcttacagcttacctagatcataaattaatcaaaatgcactttttaataaaaactgatacttaaaata

SEQ ID NO: 450609 - DNA, 2805 bp, Homo sapiens
cgcggtggcaagtcgaaagcgttcgcaccagcggggcagcggctgcgggcggcaggcggcgggcaggtcgggagtgagaaggaccggcctgggctgactgctctcccctcgcgcctagggagccggtcggagagcgcgattggggtgcggagccccgacgctgccctgccccggatttcattccgcggcgggggctccgcgagcggaattccggcggctgccgtgactccagtgcaacgtgacgacagcatgtacgatccctgaatgggcccgtgggcatatttagtcattcatttttgatcaggagaaagaagacagccatcatttgaaaggtaaagcttcagcgactgaaggagtgtggactttttgaatttcaagaacagtaaagttggaacacagcagagggtgtgtaataaaatacagattggaaagaagactgatgaagaaaaataacagcatgattcaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcaggtgatggaactgtactggaacaatgggagaagctggtagcttataggaagccaagatgaccagaatgtttttaaataatccaaggaagaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtaagtcaagtaaaagctctaagattcaatgattatgggatttgcactccaaacatctacttattatttataaatgaaatttatcaacttgttgggatcaaaacatactatttttttttcttttttaaacacataccctgttggactaacttactgtctggaagctttaaaagaaaatgttgtttgttgcctgttttatgcaagattcatacaggatgatgaataagatggttagagatgatgctctgttttcacttaataagaaagaaaactctcagacatcttcagacagtacaggctattgaacaacagatcaaccacctagtcttggttggtgttactaacccattaaataaatcgacagttggcctaagcactataaattggctgcatagcttttcccacacagagtcagacatctagagccttagcaatatgtatttaaagatgtttcacacagaattcagaacacctgttccagagtggcttgggttgttgggaaaacaataccaaagggtatgcctttgggtaggtgggaagtggatggacctgaatggattcccaccttctactactactacttaaaacaatatgtgactgttgcattcaaatttctcagagttttaagtaggcaactcccacttagttccaggtgtatccaaggtggctttcatatctgaagctctaaactcaacatggaccccctcagactggctgtttactggggttgcctacattgtcccttcactgatgtttgattttctccttagttaaaggaacgccttatggttttccatgaattgagggttggaaattggtttgttaaagagctgagtttctctccagtggagtgtgtttcatgatccaccatgtggttaaatattaaggaattcatcttacagcaagaaaacaaaatgcacactgagagttcatgctgaatgttctttgacagaaatgataaggtttttcctagtatgttttataacaactcttttttttaacctgataaattatatatctacaaattgaaataaaagcagttcctgacactttcccagggatggacggtcttaactggtataaagaaagccatttaactgatcagtgtttatttacagatggtttgacagtcctagagtttaagctgaatctgaaatagaattgttggtctgggctgcatttaatttggtggaagacgtttttttctgttcctttggttttaagaggctaataaataggaataggctttagaaatacaagat

SEQ ID NO: 450610 - DNA, 392 bp, Homo sapiens
tcacaacatgtgtggggactatctgtacagcggccacacggtcatgctaacacttacctacttatttatcaaagagtgtaagtctaaaagacttccattgtaatttcctcacctgccatttctcatgaactctggtcctctggtaaagctcattttctggaaaatctgctgaagcaagactggaggcttcaggaggcttgcagcttcatctcatcgccatgcaactggcacccagggaaatatgtggaaggacagaactggtcttcctgaggacgaggtgtcctggagtgtcatctgtagtactggggtggaggcagttccaagcacagcctgcagggtgtgttatgagccagttatacagctgctgtaaggagccagatggaaatctcaaa

SEQ ID NO: 450611 - DNA, 3585 bp, Homo sapiens
cgcggtggcaagtcgaaagcgttcgcaccagcggggcagcggctgcgggcggcaggcggcgggcaggtcgggagtgagaaggaccggcctgggctgactgctctcccctcgcgcctagggagccggtcggagagcgcgattggggtgcggagccccgacgctgccctgccccggatttcattccgcggcgggggctccgcgagcggaattccggcggctgccgtgactccagtgcaacgtgacgacagcatgtacgatccctgaatgggcccgtgggcatatttagtcattcatttttgatcaggagaaagaagacagccatcatttgaaaggtaaagcttcagcgactgaaggagtgtggactttttgaatttcaagaacagtaaagttggaacacagcagagggtgtgtaataaaatacagattggaaagaagactgatgaagaaaaataacagcatgattcaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcaggtgatggaactgtactggaacaatgggagaagctggtagcttataggaagccaagatgaccagaatgtttttaaataatccaaggaagaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtctattattagcagaagatttttctgcatagttggcacgctgtacctgtatcggtgtattacaatgtatgtaactacactcccagtacctggtatgcatttcaactgttctccgaagcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcatgcactgtacacatttcctgttcataagtttgggatttacataacccgcaaccaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaacaccaaatttaaagatttttaacatgtcagagagaagagagttaaaatttaaaaatgcatcttgggagagaaatttgtctatgtttctagtgcctttcttgtcttgattgtatggtcagtaggcaatcttaaatgtttttatttaaaataaagtattccttgaaaatataaatatatgtatacactactaaattttgcatttatagctaaattgaatcagaagactgcttatggttttaaaattgcaatgacttaaataatgaggttgttaattagagtcagagcctgttcacatattgtgatcaggtagcaatgacatgtaccacttaaattattttatcgtcgatttggtagttcgattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaactctaagttttactcctaacatacatatgtttggggaagtattctattctatacttgccaatgtggagaacaaaatagttttttaagaatgaagaagtatatatatccattctgtattttacgtgcagcagaattatcttccgtaggatttttttgtgtattcacaaggtgatatttgtattgtaaaacaataatggtgaaggaaataaaaaggcttttaaaatttt

SEQ ID NO: 450612 - DNA, 3644 bp, Homo sapiens
cgcggtggcaagtcgaaagcgttcgcaccagcggggcagcggctgcgggcggcaggcggcgggcaggtcgggagtgagaaggaccggcctgggctgactgctctcccctcgcgcctagggagccggtcggagagcgcgattggggtgcggagccccgacgctgccctgccccggatttcattccgcggcgggggctccgcgagcggaattccggcggctgccgtgactccagtgcaacgtgacgacagcatgtacgatccctgaatgggcccgtgggcatatttagtcattcatttttgatcaggagaaagaagacagccatcatttgaaaggtaaagcttcagcgactgaaggagtgtggactttttgaatttcaagaacagtaaagttggaacacagcagagggtgtgtaataaaatacagattggaaagaagactgatgaagaaaaataacagcatgattcaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcaggtgatggaactgtactggaacaatgggagaagctggtagcttataggaagccaagatgaccagaatgtttttaaataatccaaggaagaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtctattattagcagaagatttttctgcatagttggcacgctgtacctgtatcggtgtattacaatgtatgtaactacactcccagtacctggtatgcatttcaactgttctccgaagcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcatgcactgtacacatttcctgttcataagtttgggatttacataacccgcaaccaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaatgatgttatgaacaccaaatttaaagatttttaacatgtcagagagaagagagttaaaatttaaaaatgcatcttgggagagaaatttgtctatgtttctagtgcctttcttgtcttgattgtatggtcagtaggcaatcttaaatgtttttatttaaaataaagtattccttgaaaatataaatatatgtatacactactaaattttgcatttatagctaaattgaatcagaagactgcttatggttttaaaattgcaatgacttaaataatgaggttgttaattagagtcagagcctgttcacatattgtgatcaggtagcaatgacatgtaccacttaaattattttatcgtcgatttggtagttcgattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaactctaagttttactcctaacatacatatgtttggggaagtattctattctatacttgccaatgtggagaacaaaatagttttttaagaatgaagaagtatatatatccattctgtattttacgtgcagcagaattatcttccgtaggatttttttgtgtattcacaaggtgatatttgtattgtaaaacaataatggtgaaggaaataaaaaggcttttaaaattttgtttgttttaaatctttgtaaagttattattccagagagtatactggtatcttacagcttacctagatcataaattaatcaaaatgcactttttaataaaaactgatacttaaaata

SEQ ID NO: 450613 - DNA, 820 bp, Homo sapiens
cgcggtggcaagtcgaaagcgttcgcaccagcggggcagcggctgcgggcggcaggcggcgggcaggtcgggagtgagaaggaccggcctgggctgactgctctcccctcgcgcctagggagccggtcggagagcgcgattggggtgcggagccccgacgctgccctgccccggatttcattccgcggcgggggctccgcgagcggaattccggcggctgccgtgactccagtgcaacgtgacgacagcatgtacgatccctgaatgggcccgtgggcatatttagtcattcatttttgatcaggagaaagaagacagccatcatttgaaaggtaaagcttcagcgactgaaggagtgtggactttttgaatttcaagaacagtaaagttggaacacagcagagggtgtgtaataaaatacagattggaaagaagactgatgaagaaaaataacagcatgattcaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcagcctttaatttttatctcctcaacaatgtatcatcaagatcaggggcacccattatttcatatcctgtgacctttggtggatgtctggctttggatgcactggctctctttgtaaggcacagcctgtgttattgtcatatgtcaccgtgatcctttaggatttttgtagtctttttttttttccatctaccaatgaagaacactacaaatgta

SEQ ID NO: 450614 - DNA, 415 bp, Homo sapiens
tttaagtgtgagtgtgggtgaacctgaatggctttaaatcagaagaatgcctaattgttcatttcccagaggccagaaagacttgcaaataaagttaattgtggtactttggaaatatggaatagtggaagggttgtatagtcaaatctttaagttagagtgtagagcaggggtctgcaaactgtggattgctggccagatatagcctgtcatgtgtgtttgtatggcttgtaagatagcttttatgttttttaaatgattgaaaaaattcagaagattttgtgacattacaggaaattcagatttcagtgcatagcccaggtactctttgggagactgaggcaagaggatcacttgaaaccaggaatttgagaacaccctggtcaatatagtgatatcctatctctaccaaaaa

SEQ ID NO: 450615 - DNA, 2947 bp, Homo sapiens
actttgtagcttaaccaacaaacatttatttctcattgttctggaggctagaaatctgagatcagggtgctagcagagacaggttctggcaagggtctttgccaacttttgctgtattctcacatagcagaaagagagctaaaaagccgtctggtacctcttcttacagaggcaccaatccaattcatgtgggctccaccctcatgacctaatcacctcaaaaggtcccaccacataataccatcacactggggattcaatttcaacatgtgaattttgggggaacacaaacactcagtccataacactcccccagcccacctctgctgccttttctctttgaaagcacttaccttctctttctgcattgatgtaatgccagaggattggatctgggaaaggaagtaaatgtgggagggaagaatcagggttcagccatttagcgagcacaagtaggtgccgtgtgtcagcaagggtaccctgtgcatgagttattttaccacccttacagcaatccagcaggcctgtgtgataagtgttgtgtttcctgtgtggtagacgaggagaccgagactcagaagtgacgtgatttttctcaaggtattagctggcaaattgtagactagaatccaggtctcctgagtgtgggttctgtttatctagtttacctactgcgccggcctctaagactttggggtctgaatatgtacctcttcataccactagagccccagcagtcttctaagtgacatgtgagccatactggggaggagtttggggaaaggagaccttaccactgacagcagagtctgggggctcacaagagaggaagatgcccactgggaagccagatctcaggttcttcagacctatacctccctgggatataattcaatcaagtgcattagttcccctctttaaaaaaaactaaaatgatgcagaaactaactatgaaacaaaggaagaaaaaacaagagaaggcagggattatttcccaggacattttcctctgaccaggagggtaagttggggacagaggaccgacttggtggggatcagaggcagcccaagggagaagagtcattccttctactctcccacctgtcctcattgctggctctgacccagatgagagctgggggcgttgacatgggaagcttctctccttcctgagtggtcagtgaggggcagcttctcctcctactccaggagggttgcgggaacctgcatgttgcatcccagagcagccagagcttcttcttgccagtctcctaccttccctttctggctcctttactcccacctcctcatgccctctttctcatttaatagcagggagaaaggaaatgaaacttgatggagcctgactgtgccaggcactgtgccaagaactttgtgttcatttgtttctagaagagggcttggtatactgtagatgctcaataaacgttaactcttagctttagtgtctccggtccttcacttcagtgatctctaggcacagttgatggctcagtttcacaactgctgcagagaggatgaaagaacaatgtcaagtggttgggtgggggaaaatgaaactggcattagggctaatcacatacatttctcagggtgctcctcttttgaggccctatttccatgagaaggaaattgaggcaaacccagaagttgacagcttagctgggaaccaaagatgatgatatacgggagcccatggaatctcatagctcgagcagcacttttggcaccaacctgcacccaaagagcatctttaaaagttgtcacatacttgctccgggcagctctttcacaccactaccatgctctgtgccagacatgactaattttttaaatctctgacactcttaattagtcatgagctaattctgtaagaatgttagagtaagcacactaaaattatattcttctgcaaagagaaagaagattacctgagaccacttgtcccccctcaaagaagcaaggtctcagccaaaatctttgaagccttgtgacatcaatagattttctagggtggcatcatgtccttttgatttttctgtatatagtagttcaaatgccaccttctcctctcctttccattgccactgccctggctaggtcctcatcagtgccatcaactctcaccaggctccctgccaccaatccaaacaaaaccaaacactactaatcatggatcttcatgggcacgtttgctttcgttggctccaaaagcctccagtggctttccattgcagattggaaaggtctagactcagcgatcaaaacttccaccactgattgcttttccaaacatctcccctacttcctgttgtgaataccacctggtttacttattatctctggcttgccattatctggtttacttattatcatcaatatgtctagacccttctgatcttcccaactttacccgtgccttttcagttctcttcttctcattcctcaccactgatggacagtcatccttccttccaagaagggcttaagtctggttgcctggactctagataatttccctcctccttagcaattccacctttgattgtctggactccttgtgccatgtacaattatcctgtattgttaattgtctttctatgtctgtaacttgcttctgtgttatagacatcatcatggcacagtgccgtgctttttcacagaataggtacttaatattctattatttaatttactagaactttgcaatttcataaagataactttgtcattaaaaatgtttccagtggggatttagggcccttgagatggtgcaagaaaaggagataaagggttttttttaagctatttgttctttctgtgcaaattacataacttccaattatttccaacgttaaagaaatagtccctctgaatcctttatgatttaaacattaaaatgattcactagtttttagaaaaaaaa

SEQ ID NO: 450616 - DNA, 3509 bp, Homo sapiens
gtcgcgccgagggaagcggcccgcggcggagggaggggaggccgagtcctggaagcggagctccgcgctgggactggttccttcgcagccattttctgtccaaccaaacagccgattggagacgggagccaaccagggctgcattggaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaaggcaggcagatcactttgaggtcaggagtttgagaccagcctggccaacatggagaaccccccgtctctacaaaaaatacaaaattagcagggtgtggtggtgcacacctgtagtcccttactccctggtggctgaggcattatcccttgaacctgggaggcagagcctaaagtgagccgagatcgcgccactgcactccagcctgggtgacacagcaagactcttgtctcaaacaaacaggaatttgagtaaattttaaattagtatatactacaacaaatttccaaacttcataatttgctagtagtgctaactaaaattttacaccaggtaaaatcaggtcaccttttttatgtattgacttcattgttggacttcatactctgatgggaaagaaaatggacattctgaatgtgtcaggtgcataatatcctaatttatgcttgtcagagctggggtctctgtcttccttggcccatgttgcatttaactgaatgtcatgttttctcctctggaacttcttatgtatgcaagctcccatgttaacctatcataaaaatgttttttataattttgt

SEQ ID NO: 450617 - DNA, 2200 bp, Homo sapiens
  misc_feature (1794)..(1794): n is a, c, g, or t
gtcgcgccgagggaagcggcccgcggcggagggaggggaggccgagtcctggaagcggagctccgcgctgggactggttccttcgcagccattttctgtccaaccaaacagccgattggagacgggagccaaccagggctgcattggaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaaccaaaaaaaaaaaaaaaaaaaaaaaaaaaaactttttggcgcgcggcctttggcgccctctggagaaacgttttttatacaaccattcggtttgggcacgcccggggcccgcaggttggtgttaggttagacccctggcgctcatataggcgtgttccctatagaaaaccctgggctagtgagtatgtggtgttgtgggatttctctccccatattaaaaaaacgcgcccgggggggaaacaccgaggcggtttctcgtgaaaacaaaaatctcccagagatgtggagtgtttcggagaggcctccaatagcgcgggagctctcttatctacccgcgaggagggttctccccagcgcggagaagcctcgcgaatatatctaaataaattatagcgcccccgcgcgcnggttgtgaatagcgccactcaaccacgcagcaacacaagcaaagcgagcatgctagattgagacaaacacacgaacgcgagacaaaagcgcacagagacgaaaggaggacgaaacacatgcgaaacgatgcaacagagacgacagaggggagagaacagaagagcacagtgaagagcacggacagagaaggacaggagaggagagcaagcgacggagagaagcggaagagacacggcgagcagagaaagaacatggccagaagacgcacacggatcaagacgcggcacaagaacaaccgaggagagcagaagaacagaagagcggcggaagaagaccgccgcgcgcaggaggccaacacaggggagcgacgcacgaggagagacaagctggcgaagcgcagggacc

SEQ ID NO: 450618 - DNA, 1504 bp, Homo sapiens
gtcgcgccgagggaagcggcccgcggcggagggaggggaggccgagtcctggaagcggagctccgcgctgggactggttccttcgcagccattttctgtccaaccaaacagccgattggagacgggagccaaccagggctgcattggaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacgttattctactcgttatcctacttccactcttccttttcactctctttatcctaacctctctttcttctcttacttctcctccttactctctctccgccttcatctttctctctcg

SEQ ID NO: 450619 - DNA, 1356 bp, Homo sapiens
gtcgcgccgagggaagcggcccgcggcggagggaggggaggccgagtcctggaagcggagctccgcgctgggactggttccttcgcagccattttctgtccaaccaaacagccgattggagacgggagccaaccagggctgcattggaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcataaaaaaaactgggcggcgtttacacggcgtgatgggcctggcgtacccacttatcggctggagacatacccttcgcagctgggtatacg

SEQ ID NO: 450620 - DNA, 3530 bp, Homo sapiens
ggagtttgccataaagtgcctgccctctagcctctactcttccagttgcggcttattgcatcacagtaattgctgtacgaaggtcagaatcgctacctatgtccaaagcagtcgtaagaagaggtcccaatcccccactctttccgccctaatggaggtctccagtttcggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaaggcaggcagatcactttgaggtcaggagtttgagaccagcctggccaacatggagaaccccccgtctctacaaaaaatacaaaattagcagggtgtggtggtgcacacctgtagtcccttactccctggtggctgaggcattatcccttgaacctgggaggcagagcctaaagtgagccgagatcgcgccactgcactccagcctgggtgacacagcaagactcttgtctcaaacaaacaggaatttgagtaaattttaaattagtatatactacaacaaatttccaaacttcataatttgctagtagtgctaactaaaattttacaccaggtaaaatcaggtcaccttttttatgtattgacttcattgttggacttcatactctgatgggaaagaaaatggacattctgaatgtgtcaggtgcataatatcctaatttatgcttgtcagagctggggtctctgtcttccttggcccatgttgcatttaactgaatgtcatgttttctcctctggaacttcttatgtatgcaagctcccatgttaacctatcataaaaatgttttttataattttgt

SEQ ID NO: 450621 - DNA, 1039 bp, Homo sapiens
gtcgcgccgagggaagcggcccgcggcggagggaggggaggccgagtcctggaagcggagctccgcgctgggactggttccttcgcagccattttctgtccaaccaaacagccgattggagacgggagccaaccagggctgcattggaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgcgaccagctagggatcgtctaga

SEQ ID NO: 450622 - DNA, 3205 bp, Homo sapiens
gatagcacacattgtgttaatgttataacatatatttaagagattaaatagtcataaagtgaagatgtgttcttctgaataggctttcatttttgtaggttgttaggaaggtgatggttatagtttctgtaatttacctatgattttctcttcagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaaggcaggcagatcactttgaggtcaggagtttgagaccagcctggccaacatggagaaccccccgtctctacaaaaaatacaaaattagcagggtgtggtggtgcacacctgtagtcccttactccctggtggctgaggcattatcccttgaacctgggaggcagagcctaaagtgagccgagatcgcgccactgcactccagcctgggtgacacagcaagactcttgtctcaaacaaacaggaatttgagtaaattttaaattagtatatactacaacaaatttccaaacttcataatttgctagtagtgctaactaaaattttacaccaggtaaaatcaggtcaccttttttatgtattgacttcattgttggacttcatactctgatgggaaagaaaatggacattctgaatgtgtcaggtgcataatatcctaatttatgcttgtcagagctggggtctctgtcttccttggcccatgttgcatttaactgaatgtcatgttttctcctctggaacttcttatgtatgcaagctcccatgttaacctatcataaaaatgttttttataattttgt

SEQ ID NO: 450623 - DNA, 3962 bp, Homo sapiens
ggccgaggccgggccccgcgcctgcgaggccgctcccgcagcgggccgggccggggagcgggcgcggggccgcggcgcggctctttgtgcgccgggctgaggagcggcgggacgcgggccaggccacctcaccctcgccgccgttgagctccgggcccggggccgaggaggggccgcggggctgcgtcggggccccgctctcgacggcgtcccgggccggctccattttgtgcggggagccggccgaggggcgggagacgcggcccgggccctggccccgtagccccggcggcggcgcgagtccccgggggcgccctcctcccgcccgcggggctgtggcggggcccggcgctttgtctgcccgcacatcccgggggccgcgcggcgggtgggaggcaggcgttgggcgcggggccggggcggccgggcgagtcaggggatgcgctctgggggcggcctcctggcactcgcagggctgacaggtcgccgggaccaggccgtggggccggggccacccaggcacctgcgtggggaggaaggcatggctttagcttccccgcagcctggtttgcgcgtaaagaatgcagccatctggcggtttgcggtccctgtacttgccccgaaggtgggaaggaagcccttcggattggactaaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaaggcaggcagatcactttgaggtcaggagtttgagaccagcctggccaacatggagaaccccccgtctctacaaaaaatacaaaattagcagggtgtggtggtgcacacctgtagtcccttactccctggtggctgaggcattatcccttgaacctgggaggcagagcctaaagtgagccgagatcgcgccactgcactccagcctgggtgacacagcaagactcttgtctcaaacaaacaggaatttgagtaaattttaaattagtatatactacaacaaatttccaaacttcataatttgctagtagtgctaactaaaattttacaccaggtaaaatcaggtcaccttttttatgtattgacttcattgttggacttcatactctgatgggaaagaaaatggacattctgaatgtgtcaggtgcataatatcctaatttatgcttgtcagagctggggtctctgtcttccttggcccatgttgcatttaactgaatgtcatgttttctcctctggaacttcttatgtatgcaagctcccatgttaacctatcataaaaatgttttttataattttgt

SEQ ID NO: 450624 - DNA, 1388 bp, Homo sapiens
gtcgcgccgagggaagcggcccgcggcggagggaggggaggccgagtcctggaagcggagctccgcgctgggactggttccttcgcagccattttctgtccaaccaaacagccgattggagacgggagccaaccagggctgcattggaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaac

SEQ ID NO: 450625 - DNA, 3455 bp, Homo sapiens
gtcgcgccgagggaagcggcccgcggcggagggaggggaggccgagtcctggaagcggagctccgcgctgggactggttccttcgcagccattttctgtccaaccaaacagccgattggagacgggagccaaccagggctgcattggaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattttgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaaggcaggcagatcactttgaggtcaggagtttgagaccagcctggccaacatggagaaccccccgtctctacaaaaaatacaaaattagcagggtgtggtggtgcacacctgtagtcccttactccctggtggctgaggcattatcccttgaacctgggaggcagagcctaaagtgagccgagatcgcgccactgcactccagcctgggtgacacagcaagactcttgtctcaaacaaacaggaatttgagtaaattttaaattagtatatactacaacaaatttccaaacttcataatttgctagtagtgctaactaaaattttacaccaggtaaaatcaggtcaccttttttatgtattgacttcattgttggacttcatactctgatgggaaagaaaatggacattctgaatgtgtcaggtgcataatatcctaatttatgcttgtcagagctggggtctctgtcttccttggcccatgttgcatttaactgaatgtcatgttttctcctctggaacttcttatgtatgcaagctcccatgttaacctatcataaaaatgttttttataattttgt

SEQ ID NO: 450626 - DNA, 3985 bp, Homo sapiens
ggccgaggccgggccccgcgcctgcgaggccgctcccgcagcgggccgggccggggagcgggcgcggggccgcggcgcggctctttgtgcgccgggctgaggagcggcgggacgcgggccaggccacctcaccctcgccgccgttgagctccgggcccggggccgaggaggggccgcggggctgcgtcggggccccgctctcgacggcgtcccgggccggctccattttgtgcggggagccggccgaggggcgggagacgcggcccgggccctggccccgtagccccggcggcggcgcgagtccccgggggcgccctcctcccgcccgcggggctgtggcggggcccggcgctttgtctgcccgcacatcccgggggccgcgcggcgggtgggaggcaggcgttgggcgcggggccggggcggccgggcgagtcaggggatgcgctctgggggcggcctcctggcactcgcagggctgacaggtcgccgggaccaggccgtggggccggggccacccaggcacctgcgtggggaggaaggcatggctttagcttccccgcagcctggtttgcgcgtaaagaatgcagccatctggcggtttgcggtccctgtacttgccccgaaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaaggcaggcagatcactttgaggtcaggagtttgagaccagcctggccaacatggagaaccccccgtctctacaaaaaatacaaaattagcagggtgtggtggtgcacacctgtagtcccttactccctggtggctgaggcattatcccttgaacctgggaggcagagcctaaagtgagccgagatcgcgccactgcactccagcctgggtgacacagcaagactcttgtctcaaacaaacaggaatttgagtaaattttaaattagtatatactacaacaaatttccaaacttcataatttgctagtagtgctaactaaaattttacaccaggtaaaatcaggtcaccttttttatgtattgacttcattgttggacttcatactctgatgggaaagaaaatggacattctgaatgtgtcaggtgcataatatcctaatttatgcttgtcagagctggggtctctgtcttccttggcccatgttgcatttaactgaatgtcatgttttctcctctggaacttcttatgtatgcaagctcccatgttaacctatcataaaaatgttttttataattttgt

SEQ ID NO: 450627 - DNA, 3615 bp, Homo sapiens
ggagtttgccataaagtgcctgccctctagcctctactcttccagttgcggcttattgcatcacagtaattgctgtacgaaggtcagaatcgctacctatgtccaaagcagtcgtaagaagaggtcccaatcccccactctttccgccctaatggaggtctccagtttcggttgaaatcacaaagattagacacctttttagataggtgttcttcagcaccactgacaacacggttctgacagtatttcatgacagttatgtaacatttgtcctgcaagctgaggacagagaccttgtctgttgttgacagctacgtgaccagcacatagcatgaacctgatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaaggcaggcagatcactttgaggtcaggagtttgagaccagcctggccaacatggagaaccccccgtctctacaaaaaatacaaaattagcagggtgtggtggtgcacacctgtagtcccttactccctggtggctgaggcattatcccttgaacctgggaggcagagcctaaagtgagccgagatcgcgccactgcactccagcctgggtgacacagcaagactcttgtctcaaacaaacaggaatttgagtaaattttaaattagtatatactacaacaaatttccaaacttcataatttgctagtagtgctaactaaaattttacaccaggtaaaatcaggtcaccttttttatgtattgacttcattgttggacttcatactctgatgggaaagaaaatggacattctgaatgtgtcaggtgcataatatcctaatttatgcttgtcagagctggggtctctgtcttccttggcccatgttgcatttaactgaatgtcatgttttctcctctggaacttcttatgtatgcaagctcccatgttaacctatcataaaaatgttttttataattttgt

SEQ ID NO: 450628 - DNA, 359 bp, Homo sapiens
tgaattgcctttagtcacttgtttaaagccagttgtctagatacgtgtaggtctatttctcaactctgttccattgacttatttgtctacgtttatgcaaacaccacatactctttattattgtagtattacgttaagctttccaattagtagggttgatcctccaactgtgctcttcttcaatgttgtctaggttattctagatcctttgtgttttcatctgaattttagaatcaccttgtctatttttacaaaagctctgctgggattttttttttttttttttttttgagacagagtttcactcttgttgcccaggctggagtgcaatgatgtgatcttggctcactgcaacctcc

SEQ ID NO: 450629 - DNA, 5109 bp, Homo sapiens
gccgcagcatcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggatatgggatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgatgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaa

SEQ ID NO: 450630 - DNA, 5246 bp, Homo sapiens
  misc_feature (5065)..(5065): n is a, c, g, or t
gccgcagcatcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggatatgggatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgatgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacagcctgtgcttggtctactgataagccctctacaaaaaaacaaaactcgtgccgaattcggcacgagctttggtcatcttcacttcctgcttggagtgggcattggcactggcatctcanagaatgcccgggagcagtgtaagtctgttttcccctggcctgggttttatgtgtcctatctgtgccaccaagaagcctagaaggccaccccagcagatactacacgtgatagcaggtcttggtctaatatatctccacggagagagaggttattaccggaatgggcagacaacttggtctt

SEQ ID NO: 450631 - DNA, 4703 bp, Homo sapiens
gccgcagcatcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggatatgggatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgaggtcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgatgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaa

SEQ ID NO: 450632 - DNA, 3945 bp, Homo sapiens
gggcggctctccccttcctcccagctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgatgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaa

SEQ ID NO: 450633 - DNA, 4236 bp, Homo sapiens
gccgcagcatcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggatatgggatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaa

SEQ ID NO: 450634 - DNA, 4588 bp, Homo sapiens
gccgcagcatcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggatatgggatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaa

SEQ ID NO: 450635 - DNA, 955 bp, Homo sapiens
gccgcagcatcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggatatgggagtagctgaagggagcctgggcgcctaccttcgccgctatgttgggcccctctttatcttctacctcctcaccttctccctgttccggaccctgactcctctccctggcctttcctgggcacagggtgggcaggagatagccaggacgttgggtacccccggagagaagggcagggtagaaggtgcggggcgtgtcaggaccatggacagggacaggcgcggccgccggggcgatttcagcaccagggacagcgaacctggagcagggccccgaggtcttgggcctcctccatgctctccttagcccgccccatctctgcccgccccactccgactcctccgcttccatcccccaccacaggggtgtggcagcaggagaatggggtcgtccccagccctcagctggcttgtgcaaaggcctgtgttcaagtcttgtccccatttctctttcccctcctgggcccttggtcaccctgtctctgaactgagacaggaaaaggtggcttgaaaaaccctggtcccagcccagcagccttctggacccttttttgtgtgtagttatttggtgggggtgggggcagggctgctggagcatgtgtctatggttgtaacatttgttgggggcacaagcaggtgagtggatgttggggagtgtggccgtagggttgtg

SEQ ID NO: 450636 - DNA, 916 bp, Homo sapiens
gccgcagcatcggcatcgcagacgcgctcgggcggcgggtccgaggccggcgtgcgcggaggctgggcgggcagcccgagcggtggccgcagcgcaggacacttgaaatatacagaaaagaacaaaagaaattaagaatcgctagtgatctgatcaccaagagggaaacacgttcagcacgccccagcctccctggtttgctacaccgcgctcctaaaaggctcctccccaagttcccagctgccagctccctgctgagcatcaggaggacaatcagcgcttcaaggtggcggggtcccctgccctgcagccagtgaagagcttccctacccaggcgctcagcatcccagcgatgggcagtcgtgtactgggcagctgctcatggccagtgctcctttgggccgggctctgggctgcccatggaagagccagtgacaaactggaccagcattgtccctgtcttcgtggggtgtcacttgttttcttttttcttgatgattatctgaagggaaaagggaggcaaagagtgaggaagggcctggcctgagggctcctacagtgagcagggtgcccagattgtgcccccaatcggcctctcccaggtccgagccctttccaccactggaactacagctggcgccttccttggcatgcacctggccaggactggcaggtgagggtcgaggagacaggcctgtgtgccctaccttgatcaccaagttccctttcaaagctcgaaaaaaaaaaaaaggggggcgtaaaattatctcgagggccaagtttagcgttaccggtttttgtaaagggccttaggggggataaaagaaagaggcgggttaaagcggggggaatgtttgggttgggagaacccttgggggttggcaaccaaagtagggatattggttggagtatggga

SEQ ID NO: 450637 - DNA, 5483 bp, Homo sapiens
gccgcagcatcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggatatgggatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgatgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaaaaaaaaaaaaaaaaaaaaaaaaaaaaaaaaaaaaaaaaaaaaacaaaaaaagaaaaacaaaaaaacaaagacaaacaaaagaaaacacaaaaaacaaagaaggaggggcgcgcgcgcgcagacgacaaactctcctcccgcgcgcggcgcaccacaaaagacgcaagccgccgcgcatgctatctagtgaaagacagggaggcccaacacaaaggggaaaggcaataaaaagaaacaaagagacggggcgcgagataagacaaacacattataacggagagaacaaacaggacaacgagtaatgatgtggaggagggaaccacgcaagagggagggagcaacacagaagcagacagaaaaccatcacagcgaga

SEQ ID NO: 450638 - DNA, 4555 bp, Homo sapiens
gccgcagcatcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggatatgggatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgatgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaa

SEQ ID NO: 450639 - DNA, 5694 bp, Homo sapiens
gccgcagcatcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggatatgggatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaggtgagccggggcaggagtgggtgctggcactcagctccaccctggccttcacatctcaccccctctctctcttctctgtgctgccgggtgacttcaggtccctggagaggtaaggcaggggcggtggggaggggccaacagcaaggtctccctatagacaatgtgcgcctggtgtgccattgtcccctggctgccggggctctgacaggactctcacttcccagcccccaggcccggcagctcctcatttcagggagaggccaacacgccccagcccctcctctccacacagataccttcactgctcccctctccccaagggaggccccagacagcttcccagacaggaaccaggccccataatcccctggccgagcgcacattttctccctcacagtccccaggatctggggaatgcccaaagatgacagctccagacctgcctgccagggtggccagagctgctctttctgagcgcattctaaacaaatggaaggcaggcgggcgtctgcctcacccccagccaggctcctgcaggggctcggcagtgctctcactcgcacctgccctgtgcctctgcagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaa

SEQ ID NO: 450640 - DNA, 3788 bp, Homo sapiens
gccgcagcatcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggatatgggatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgatacaacaaggaggctcgacatgtctgggatcctctagataagaccaggagcatcactc

SEQ ID NO: 450641 - DNA, 1614 bp, Homo sapiens
gccgcagcatcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggatatgggatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggagggtatggacctcctgggacaccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaa

SEQ ID NO: 450642 - DNA, 2207 bp, Homo sapiens
tcagggtgggacgtgggcgcggggagacaggtggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaagtaaggagactggggaggggggctgggcaagggaacagaccagtgacgtgaagacatctggctcaggaccgctgatctgtgtttggcctgcagattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 450643 - DNA, 2092 bp, Homo sapiens
ttacttgtagcctgagggctcagagggagcaccggtttggagctgggaccccctattttagcttttctgtggctggtgaatggggatcccaggatctcacaatctcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 450644 - DNA, 2496 bp, Homo sapiens
ttacttgtagcctgagggctcagagggagcaccggtttggagctgggaccccctattttagcttttctgtggctggtgaatggggatcccaggatctcacaatctcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgtaacaacaaaacacacacaccaaacacacacaacacaacaaaaaaaaacaacacaaaagagggcggccacacacacaacaaaaatacccacacaagagagcccccaaaagcgaaccgcccaacacacccaagaacccgacacacacaaaagggggcgcccacaacaaggggagcccacggacagaccacacaacagaccaacagaaacacacgcagccccccgcacacgatatcacaacccacacaccaagagacacgcgcgcaacacaaaatagcaaacccagcgacgaaaccaaaactgacaaaacaacgacccaccaaaaccttcagggagagagcacacacacacagcgcgacaagaaaacccgcccaacaagacatcaacagccccacagagaggaacaaa

SEQ ID NO: 450645 - DNA, 1961 bp, Homo sapiens
tcagggtgggacgtgggcgcggggagacaggtggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 450646 - DNA, 1436 bp, Homo sapiens
ttacttgtagcctgagggctcagagggagcaccggtttggagctgggaccccctattttagcttttctgtggctggtgaatggggatcccaggatctcacaatctcaggtacttttggaactttccagggcaaggccccattatatctgatgttgggggagcagatcttgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 450647 - DNA, 1405 bp, Homo sapiens
tcagggtgggacgtgggcgcggggagacaggtggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggaggccgccaagtttcccattaagtggacagcgccagaagcctgtgccaactctctgcattcctgctcttcaccgccat

SEQ ID NO: 450648 - DNA, 2114 bp, Homo sapiens
tcagggtgggacgtgggcgcggggagacaggtggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 450649 - DNA, 2182 bp, Homo sapiens
ttacttgtagcctgagggctcagagggagcaccggtttggagctgggaccccctattttagcttttctgtggctggtgaatggggatcccaggatctcacaatctcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgacacacttctagactcccagttggaggagaaaggtctgggggcctccccctggggcaacttgggccagcaactcttgcttctgcccacagggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 450650 - DNA, 2288 bp, Homo sapiens
tcagggtgggacgtgggcgcggggagacaggtggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaaggtgaccccaggcagcagggcctgaaagacaaggcctgcggatccctggctgttggcttccacctctcccccacctactttctccccggtcttgccttccttgtcccccaccctgtaactccaggcttcctgccgatcccagctcggttctccctgatgccccttgtctttacagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 450651 - DNA, 1768 bp, Homo sapiens
aactcccatccatgtccagctgccctccactattagagaggtggtccctcagacccccagaccccctctttcttattccatccaatatattcagcacatagttattgtttcttactctcggctgggcaccaggaacatggatggatgaaacaaggttcctgttgtcagggaaacctgattttagttacagctactggggaaaccagagtttgtgccatgggaaagttccagcatgcccatgggagtgtagatgatgatccagtttattatgcctggtaggatctagagaggcttcctagtggggcagtctagcagggccacgaaagaaaagtagaattttttttagcaggcagagatgaaacaaagaggctttggggtgagagcctagtggtctgagtgcaggatctcaaaattgctaaactgtttgaagtcaaaggcagagtgggggaaagagaagaagctaccagtgtggaccatgccaagcttaggatactagttgaggattctaggttctaccttattggtgatgaaaaacctacagatccctcccagcatgctctaccctagcccctctgcaaaaaaacctttacatatcctgggcatccttaccctgaacacacactcctccattctcactcttcaatcttccttttcacatgtcagacacacttctagactcccagttggaggagaaaggtctgggggcctccccctggggcaacttgggccagcaactcttgcttctgcccacagggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 450652 - DNA, 2040 bp, Homo sapiens
tcagggtgggacgtgggcgcggggagacaggtggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 450653 - DNA, 745 bp, Homo sapiens
  misc_feature (692)..(692): n is a, c, g, or t
  misc_feature (709)..(709): n is a, c, g, or t
  misc_feature (714)..(714): n is a, c, g, or t
  misc_feature (718)..(718): n is a, c, g, or t
  misc_feature (729)..(729): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgttcctaatgtcctgaactggcgggcactgaagtatgaagtgcaaggcgaagtgttcaccaaaccccagctgtggccctgaggcccagctgtgggtaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 450654 - DNA, 2160 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450655 - DNA, 2073 bp, Homo sapiens
  misc_feature (2020)..(2020): n is a, c, g, or t
  misc_feature (2037)..(2037): n is a, c, g, or t
  misc_feature (2042)..(2042): n is a, c, g, or t
  misc_feature (2046)..(2046): n is a, c, g, or t
  misc_feature (2057)..(2057): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 450656 - DNA, 2276 bp, Homo sapiens
  misc_feature (2264)..(2264): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaccaaaaaaaccaaatacaaatcaaagccacagcacaaacacgtgtggcggccggcctcgggccccgtagaaaaaggttcttgaaaccccatctcgcggtgggcccgcggggccccacagttagttgattgagtgacacaccgtggcccaaagacgtgtaccctcagaggaaacacccgtgggcccagagaaatggcgttgtgaatttctccccagattaatagaggccgggggcgagccggcgcggntctgaaacatcg

SEQ ID NO: 450657 - DNA, 2115 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaacctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450658 - DNA, 2106 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450659 - DNA, 2189 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 450660 - DNA, 1795 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450661 - DNA, 1796 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450662 - DNA, 1653 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450663 - DNA, 1648 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450664 - DNA, 1561 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450665 - DNA, 1419 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaagagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450666 - DNA, 1210 bp, Homo sapiens
ggaaggcaagagatctaggacttctagcccctgaactttcagccgaatacatcttttccaaaggaaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450667 - DNA, 1159 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagttgccactgtagtatgccaaccaaatgagttcataatgccggacagcgccgtcgttggggacgtgctggtgttaacaaaccgttag

SEQ ID NO: 450668 - DNA, 1470 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450669 - DNA, 1406 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450670 - DNA, 1302 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450671 - DNA, 1163 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 450672 - DNA, 1291 bp, Homo sapiens
ggaaggcaagagatctaggacttctagcccctgaactttcagccgaatacatcttttccaaaggagtgaattcaggcccttgtatcactggcagcaggacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggttgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 450673 - DNA, 1167 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtatgagattaacaccatctatcttggcgggcccttcagtcctaatgtcctgaactggcgggcactgaagtatgaagtgcaaggcgaagtgttcaccaaaccccagctgtggccctgaggcccagctgtgggttgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 450674 - DNA, 1130 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgttcctaatgtcctgaactggcgggcactgaagtatgaagtgcaaggcgaagtgttcaccaaaccccagctgtggccctgaggcccagctgtgggttgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 450675 - DNA, 1036 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgttgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 450676 - DNA, 968 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 450677 - DNA, 955 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtatgagattaacaccatctatcttggcgggcccttcagtcctaatgtcctgaactggcgggcactgaagtatgaagtgcaaggcgaagtgttcaccaaaccccagctgtggccctgaggcccagctgtgggtaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 450678 - DNA, 934 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaactgaatcagccttgtctggaaccagatctacacctggactgcccaggtctataagccaataaagcccctgtttacttgtacgttgcgaaaacacacaaatctaaacataagcaacaccacaactgtttgcgcccagcctttggccccttaaaaaggtcttaacacccatactgtgttgggccacggggtccacaatatagtatagtgcaacaacgttgcccacaaggctgtgtcccaaaaggaaagccccggggcagaagacaaacgcggccggagcttcccaccccaattataaaaaacgccccggggggcaaaccagacgcgtgttctgcaaacaacacccaagagtcgcagtccagaaggcacaaacaggggcatcgtaaacagggagtcacaagccaagacccaattttagagc

SEQ ID NO: 450679 - DNA, 2246 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 450680 - DNA, 2137 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450681 - DNA, 2109 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450682 - DNA, 1970 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450683 - DNA, 1696 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450684 - DNA, 1835 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataactccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 450685 - DNA, 1531 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggttgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 450686 - DNA, 1267 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaacaataccacgcagtccctccactttagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaataaagtaaaaggatataaaagatttataaagtggtaatctttgtggataaattaaattgaaatcctcggggggggggcccggaccccaattcccccctttggggggtggttttacaattccactggccgccgttttac

SEQ ID NO: 450687 - DNA, 1113 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaactgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 450688 - DNA, 2878 bp, Homo sapiens
agcggggcttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagca

SEQ ID NO: 450689 - DNA, 952 bp, Homo sapiens
gggtatttttatttaatggtagtgagagaaaagggggtttcggtggaccatcatattcttgagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcactttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgcatc

SEQ ID NO: 450690 - DNA, 553 bp, Homo sapiens
acgtgagcctccaaagaagaaagaaaaaaagaaaaaaaagaaagctcctgaaccagaagaagaaattgaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgcatc

SEQ ID NO: 450691 - DNA, 2722 bp, Homo sapiens
agcggggcttcccaggaccctcagggagagcgggcagccttccaggtggacaggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagca

SEQ ID NO: 450692 - DNA, 3924 bp, Homo sapiens
agcggggcttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcatttctgacctggtctggcctgatctctgtgttgggcaagagagggtacaatttgagcagttctcctgagttagactcggctcaaagtctctcttttaaagtgaaaagccacctttctcattgcttttttcataggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcactttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgcatc

SEQ ID NO: 450693 - DNA, 2884 bp, Homo sapiens
  misc_feature (2783)..(2783): n is a, c, g, or t
agcggggcttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatattcacagtccgccgtttaaatgggtctatacgggngttgagcctaaaagaaacccctctaacccatttacctgtacaccgatttttttgcaagttttccgcccaaatacccgggggggcggcaccacccatggggg

SEQ ID NO: 450694 - DNA, 2744 bp, Homo sapiens
agcggggcttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcatttctgacctggtctggcctgatctctgtgttgggcaagagagggtacaatttgagcagttctcctgagttagactcggctcaaagtctctcttttaaagtgaaaagccacctttctcattgcttttttcataggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcactttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgcatc
